US007476390B2

(12) United States Patent
Apt et al.

(10) Patent No.: US 7,476,390 B2
(45) Date of Patent: Jan. 13, 2009

(54) *FLAVIVIRUS* ANTIGENS

(75) Inventors: Doris Apt, San Jose, CA (US); Juha Punnonen, Belmont, CA (US); Alice M. Brinkman, Tustin, CA (US)

(73) Assignee: Maxygen, Inc., Redwood City, CA (US)

( * ) Notice: Subject to any disclaimer, the term of this patent is extended or adjusted under 35 U.S.C. 154(b) by 842 days.

(21) Appl. No.: 10/375,932

(22) Filed: Feb. 26, 2003

(65) Prior Publication Data

US 2004/0009469 A1 Jan. 15, 2004

Related U.S. Application Data

(60) Provisional application No. 60/360,030, filed on Feb. 26, 2002.

(51) Int. Cl.
*A61K 39/12* (2006.01)
(52) U.S. Cl. .................................................. 424/218.1
(58) Field of Classification Search ............... 424/218.1
See application file for complete search history.

(56) References Cited

U.S. PATENT DOCUMENTS

| 5,744,140 | A | 4/1998 | Paoletti et al. |
| 5,744,141 | A | 4/1998 | Paoletti et al. |
| 6,096,548 | A | 8/2000 | Stemmer |
| 6,136,561 | A | 10/2000 | Ivy et al. |
| 6,165,477 | A | 12/2000 | Ivy et al. |
| 6,184,024 | B1 | 2/2001 | Lai et al. |
| 6,541,011 | B2 | 4/2003 | Punnonen et al. |
| 6,569,435 | B1 | 5/2003 | Punnonen et al. |
| 6,576,757 | B1 | 6/2003 | Punnonen et al. |

FOREIGN PATENT DOCUMENTS

| WO | WO 93/06214 | 4/1993 |
| WO | WO 94/06421 | 3/1994 |
| WO | WO 99/41368 | 8/1999 |
| WO | WO 99/41369 | 8/1999 |
| WO | WO 99/41383 | 8/1999 |
| WO | WO 99/41402 | 8/1999 |

OTHER PUBLICATIONS

Aberle, Judith H. et al., "A DNA immunization model study with constructs expressing the tick-borne encephalitis virus envelope protein E in different physical forms," *Journal of Immunology* 163:6756-6761 (1999).
Bhamarapravati, N. et al., "Live attenuated tetravalent dengue vaccine," *Vaccine* 18:44-47 (2000).
Bielefeldt-Ohmann, Helle et al., "Analysis of a recombinant dengue-2 virus-dengue-3 virus hybrid envelope protein expressed in a secretory baculovirus system," *Journal of General Virology* 78:2723-2733 (1997).
Billoir, Frederique et al., "Phylogeny of the genus *Flavivirus* using complete coding sequences of arthropod-borne viruses and viruses with no known vector," *Journal of General Virology* 81:781-790 (2000).

Guirakhoo, F. et al., "Construction, Safety, and Immunogenicity in nonhuman primates of a chimeric yellow fever-dengue virus tetravalent vaccine," *Journal of Virology*, 7290-7304 (Aug. 2001).
Chang, Gwong-Jen J. et al., "Enhancing biosynthesis and secretion of premembrane and envelope proteins by the chimeric plasmid of dengue virue type 2 and Japanese encephalitis virus," *Virology* 306:170-180 (2003).
Kanesa-thasan, N. et al., "Safety and immunogenicity of attenuated dengue virus vaccines (Aventis Pasteur) in human volunteers," *Vaccine* 19:3179-3188 (2001).
Kuhn, Richard J. et al., "Structure of dengue virus: implications for flavivirus organization, maturation, and fusion," *Cell* 108:717-725 (Mar. 2002).
Kuno, Goro et al., "Phylogeny of the Genus *Flavivirus*," *Journal of Virology* 72(1):73-83 (Jan. 1998).
McMinn, Peter C., "The molecular basis of virulence of the encephalitogenic flaviviruses," *Journal of General Virology* 78:2711-2722 (1997).
Monath, Thomas P. et al., "Clinical proof of principle for ChimeriVax™: recombinant live, attenuated vaccines against flavivirus infections," *Vaccine* 1004-1018 (2002).
Nielsen, Henrik et al., "Identification of prokaryotic and eukaryotic signal peptides and prediction of their cleavage sites," *Protein Engineering* 10(1):1-6 (1997).
Pletnev, Alexander G. et al., "Chimeric tick-borne encephalitis and dengue type 4 viruses: effects of mutations on neurovirulence in mice," *Journal of Virology* 67(8):4956-4963 (Aug. 1993).
Raviprakash, K. et al., "Immunogenicity of dengue virus type 1 DNA vaccines expressing truncated and full length envelope protein," *Vaccine* 18:2426-2434 (2000).
Thullier, Philippe et al., "Mapping of a dengue virus neutralizing epitope critical for the infectivity of all serotypes: insight into the neutralization mechanism," *Journal of General Virology* 82:1885-1892 (2001).
Vaughn, David W. et al., "Testing of a dengue 2 live-attenuated vaccine (strain 16681 PDK 53) in ten American volunteers," *Vaccine* 14(4):329-336 (1996).
Whitehorn, Erik et al., "A generic method for expression and use of "tagged" soluble versions of cell surface receptors," *Biotechnology* 13:1215-1219 (Nov. 1995).
Beasley, David W.C. et al., "Epitopes on the dengue 1 virus envelope protein recognized by neutralizing IgM monoclonal antibodies," *Virology* 279:447-458 (2001).
Bhamarapravati, N. et al., "Immunization with a live attenuated dengue-2-virus candidate vaccine (16681-PDK 53): clinical, immunological and biological responses in adult volunteers," *Bulletin of the World Health Organization* 65(2):189-195 (1987).

(Continued)

*Primary Examiner*—Jeffrey S. Parkin
(74) *Attorney, Agent, or Firm*—Margaret A. Powers

(57) ABSTRACT

The invention provides polynucleotides and polypeptides encoded therefrom having advantageous properties, including an ability to induce an immune response to flaviviruses. The polypeptides and polynucleotides of the invention are useful in methods of inducing immune response against flaviviruses, including dengue viruses. Compositions and methods for utilizing polynucleotides and polypeptides of the invention are also provided.

14 Claims, 18 Drawing Sheets

OTHER PUBLICATIONS

Bray, Michael et al., "Monkeys immunized with intertypic chimeric dengue viruses are protected against wild-type virus challenge," *Journal of Virology* 70(6):4162-4166 (Jun. 1996).

Butrapet, Siritorn et al., "Attenuation markers of a candidate dengue type 2 vaccine virus, strain 16681 (PDK-53), are defined by mutations in the 5' noncoding region and nonstructural proteins 1 and 3," *Journal of Virology* 74(7):3011-3019 (Apr. 2000).

Chen, Weiran et al., "Construction of intertypic chimeric dengue viruses exhibiting type 3 antigenicity and neurovirulence for mice," *Journal of Virology* 69(8): 5186-5190 (Aug. 1995).

Chu, May C. et al., "Genetic relatedness among structural protein genes of dengue 1 virus strains," *Journal of General Virology* 70:1701-1712 (1989).

Chu, M.C. et al., GenBank Accession No. B32401 (definition: genome polyprotein—dengue virus type 1; strain AHF 82-80; fragment) (Jun. 7, 1996).

Delenda, Christophe et al., "Analysis of C-terminally truncated dengue 2 and dengue 3 virus envelope glycoproteins: processing in insect cells and immunogenic properties in mice," *Journal of General Virology* 75:1569-1578 (1994).

Eckels, Kenneth H. et al., "Immunization of monkeys with baculovirus-dengue type-4 recombinants containing envelope and nonstructural proteins: evidence of priming and partial protection," *Am. J. Trop. Med. Hyg.* 50(4):472-478 (1994).

Falconar, A.K.I., "Identification of an epitope on the dengue virus membrane (M) protein defined by cross-protective monoclonal antibodies: design of an improved epitope sequence based on common determinants present in both envelope (E and M) proteins," *Arch. Virol*. 144:2313-2330 (1999).

Fong, M.Y. et al., GenBank Accession No. AAD37781 (definition: envelope protein; Dengue virus type 3) (Jun. 8, 1999).

Guirakhoo, F. et al., "Construction, safety, and immunogenicity in nonhuman primates of a chimeric yellow fever dengue virus tetravalent vaccine," *Journal of Virology* 75(16):7290-7304 (Aug. 2001).

Guirakhoo, F. et al., "Recombinant chimeric yellow fever-dengue type 2 virus is immunogenic and protective in nonhuman primates," *Journal of Virology* 74(12):5477-5485 (Jun. 2000).

Hiramatsu, Kazufumi et al., "Mutational analysis of a neutralization epitope on the dengue type 2 virus (DEN2) envelope protein: monoclonal antibody resistant DEN2/DEN4 chimeras exhibit reduced mouse neurovirulence," *Virology* 224:437-445 (1996).

Huang, Claire Y.-H. et al., "Chimeric dengue type 2 (vaccine strain PDK-53)/dengue type 1 virus as a potential candidate dengue type 1 virus vaccine," *Journal of Virology* 74(7):3020-3028 (Apr. 2000).

Jennings, A.D. et al., "Comparison of the nucleotide and deduced amino acid sequences of the structural protein genes of the yellow fever 17DD vaccine strain from Senegal with those of other yellow fever vaccine viruses," *Vaccine* 11(6):679-681 (1993).

Jimenez, Raquel O. et al., "Recombinant plasmid expressing a truncated dengue-2 virus E protein without co-expression of prM protein induces partial protection in mice," *Vaccine* 19:648-654 (2001).

Johnson, Alison J. et al., "New mouse model for dengue virus vaccine testing," *Journal of Virology* 73(1):783-786 (Jan. 1999).

Kanesa-Thasan, Niranjan et al., "New and improved vaccines for dengue, Japanese encephalitis, and yellow fever viruses," in New Generation Vaccines 587-606 (Myron M. Levine et al. eds., 2nd ed. 1997).

Kelly, Eileen P. et al., "Purified dengue 2 virus envelope glycoprotein aggregates produced by baculovirus are immunogenic in mice," *Vaccine* 18:2549-2559 (2000).

Kochel, T.J. et al., "A dengue virus serotype-1 DNA vaccine induces virus neutralizing antibodies and provides protection from viral challenge in aotus monkeys," *Vaccine* 18:3166-3173 (2000).

Kochel, Tadeusz et al., "Inoculation of plasmids expressing the dengue-2 envelope gene elicit neutralizing antibodies in mice," *Vaccine* 15(5):547-552 (1997).

Konishi, Eiji et al., "A DNA vaccine expressing dengue type 2 virus premembrane and envelope genes induces neutralizing antibody and memory B cells in mice," *Vaccine* 18:1133-1139 (2000).

Lanciotti, Robert S. et al., "Molecular evolution and phylogeny of dengue-4 viruses," *Journal of General Virology* 78:2279-2286 (1997).

Lanciotti, R.S. GenBank Book Accession No. AAB70693 (definition: polyprotein; Dengue virus type 4) (Sep. 19, 1997).

McBride, William J.H. et al., "Dengue viral infections; pathogenesis and epidemiology," *Microbes and Infection* 2:1041-1050 (2000).

Men, Ruhe et al., "Immunization of rhesus monkeys with a recombinant of modified vaccinia virus Ankara expressing a truncated envelope glycoprotein of dengue type 2 virus induced resistance to dengue type 2 virus challenge," *Vaccine* 18:3113-3122 (2000).

Men, Ruhe et al., "Dengue type 4 virus mutants containing deletions in the 3' noncoding region of the RNA genome: analysis of growth restriction in cell culture and altered viremia pattern and immunogenicity in rhesus monkeys," *Journal of Virology* 70(6):3930-3937( Jun. 1996).

Men, Ruhe et al., "Carboxy-terminally truncated dengue virus envelope glycoproteins expressed on the cell surface and secreted extracellularly exhibit increased immunogenicity in mice," *Journal of Virology* 65(3):1400-1407 (Mar. 1991).

Monath, Thomas P. et al., "Clinical proof of principle for Chimerivax™ recombinant live, attenuated vaccines against flavivirus infections," *Vaccine* 20:1004-1018 (2002).

Most, Robert G. Van der et al., "Chimeric yellow fever/dengue virus as a candidate dengue vaccine: quantitation of the dengue virus-specific CD8 T-cell response," *Journal of Virology* 74(17):8094-8101 (Sep. 2000).

Pletnev, Alexander G. et al., "West Nile virus/dengue type 4 virus chimeras that are reduced in neurovirulence and peripheral virulence without loss of immunogenicity or protective efficacy," *PNAS* 99(5):3036-3041 (Mar. 2002).

Porter, K.R. et al., "Protective efficacy of a dengue 2 DNA vaccine in mice and the effect of CpG immuno-stimulatory motifs on antibody responses," *Archives of Virology* 143:997-1003 (1998).

Raviprakash, Kanakatte et al., "Dengue virus type 1 DNA vaccine induces protective immune responses in rhesus macaques," *Journal of General Virology* 81:1659-1667 (2000).

Smucny, John J. et al., "Murine immunoglobulin G subclass responses following immunization with live dengue virus or a recombinant dengue envelope protein," *Am. J. Trop. Med. Hyg*. 53(4):432-437 (1995).

Staropoli, Isabelle et al., "Affinity-purified dengue-2 virus envelope glycoprotein induces neutralizing antibodies and protective immunity in mice," *Vaccine* 15(17-18):1946-1954 (1997).

Velzing, J. et al., "Induction of protective immunity against Dengue virus type 2: comparison of candidate live attenuated and recombinant vaccines," *Vaccine* 17:1312-1320 (1999).

Whitehead, Stephen S. et al., "A live, attenuated Dengue virus type 1 vaccine candidate with a 30-nucleotide deletion in the 3' untranslated region is highly attenuated and immunogenic in monkeys," *Journal of Virology* 77(2):1653-1657 (Jan. 2003).

Yang, P.Y. et al., GenBank Accession No. P30026 (definition: Genome polyprotein [Contains: Capsid protein C (Core protein); Envelope protein M (Matrix protein); Major envelope protein E; Nonstructural protein 1 (NS1)] (1991; revision date Dec. 15, 1998).

Apt, Doris et al., "Tetravalent neutralizing antibody response against four dengue serotypes by a single chimeric dengue envelope protein," Vaccine 24:335-344 (2006).

Guirakhoo, F. et al., "Safety and efficacy of chimeric yellow fever-dengue virus tetravalent vaccine formulations in nonhuman primates," J. Virology 78(9):4761-4775 (May 2004).

Raviprakash, Kanakatte et al., "A chimeric tetravalent dengue DNA vaccine elicits neutralizing antibody to all four virus serotypes in rhesus macaques," Virology 353:166-173 (Sep. 15, 2006).

FIG. 7

FIG. 8A
- Mice vaccinated with plasmid DNA encoding PRM15/tE polypeptides
- Sera analyzed by Plaque Reduction Neutralization Test (PRNT)

50% neutralizing titers (Day 76) against 4 DEN viruses

| Vaccinated mice | DEN-1 | DEN-2 | DEN-3 | DEN-4 |
|---|---|---|---|---|
| DEN-1 wt | <20 | <20 | <20 | <20 |
| DEN-2 wt | <20 | <20 | <20 | <20 |
| DEN-3 wt | <20 | <20 | >80 | <20 |
| DEN-4 wt | <20 | <20 | <20 | 35 |
| wtDEN-1-4-Mix | <20 | <20 | <20 | <20 |
| sh18D7 | >80 | >80 | 35 | <20 |
| sh18E9 | 70 | 60 | <20 | <20 |
| sh6E12 | 35 | >80 | 70 | <20 |
| sh2/7 | 35 | >80 | 70 | 30 |
| sh2G11 | 50 | 60 | 40 | 30 |
| sh16B4 | 60 | >80 | >80 | 70 |
| sh18H2 | 70 | >80 | 60 | 70 |
| sh15D4 | >80 | >80 | 80 | >20 |
| sh16G11 | 80 | >80 | 80 | 50 |
| sh18H6 | >80 | >80 | >80 | 70 |

FIG. 8B

- Mice vaccinated with plasmid DNA encoding C15/full prM/full E polypeptides
- Sera analyzed by Plaque Reduction Neutralization Test (PRNT)

50% neutralizing titers (Day 76) against 4 DEN viruses

| Vaccinated mice | DEN-1 | DEN-2 | DEN-3 | DEN-4 |
|---|---|---|---|---|
| DEN-1 wt | <20 | <20 | <20 | <20 |
| DEN-2 wt | <20 | <20 | <20 | <20 |
| DEN-3 wt | <20 | 35 | >80 | 40 |
| DEN-4 wt | <20 | 65 | 60 | >80 |
| wtDEN-1-4-Mix | 25 | 35 | >80 | >80 |
| | | | | |
| 5/21-D1 | 35 | >80 | 45 | 70 |
| 2G11-D4 | 80 | >80 | 75 | >80 |
| 6E12-D4 | >80 | >80 | >80 | >80 |

A.
Coomassie Blue stained PAA Gel

B.
DEN-Ab stained Western Blot Filter

FLAVIVIRUS ANTIGENS

CROSS REFERENCE TO RELATED APPLICATION

This application claims priority to and benefit of provisional U.S. patent application Ser. No. 60/360,030, filed Feb. 26, 2002, the disclosure of which is incorporated herein by reference in its entirety for all purposes.

STATEMENT REGARDING FEDERALLY SPONSORED RESEARCH AND DEVELOPMENT

This invention was developed in part with Government support by a grant from the Defense Advanced Research Projects Agency (DARPA) (Grant No. N65236-99-1-5421). The Government may have certain rights in this invention.

COPYRIGHT NOTIFICATION

Pursuant to 37 C.F.R. 1.71(e), Applicants note that a portion of this disclosure contains material which is subject to copyright protection. The copyright owner has no objection to the facsimile reproduction by anyone of the patent document or patent disclosure, as it appears in the Patent and Trademark Office patent file or records, but otherwise reserves all copyright rights whatsoever.

FIELD OF THE INVENTION

This invention pertains generally to polypeptides that induce an immune response against one or more dengue viruses and/or other flaviviruses, polynucleotides encoding such polypeptides, methods of making and using such polypeptides, polynucleotides, and diagnostic assays employing such polypeptide and polynucleotides.

BACKGROUND OF THE INVENTION

Viruses of the *Flavivirus* genus are positive-sense, single-stranded RNA viruses of the *Flaviviridae* family, many of which are responsible for disease in humans and other mammals. Examples of flaviviruses include Tick-borne encephalitis virus, Japanese encephalitis virus, Yellow Fever virus, St. Louis encephalitis virus, hepatitis C virus, and West Nile viruses. Flaviviruses of the *Flavivirus* genus generally comprise three major mature structural proteins: an envelope (E) protein, a capsid (C) protein, and a membrane (M) protein. The M protein is usually formed as a proteolytic fragment of a pre-membrane (prM) protein. See, e.g., Fields Virology 997-998, Raven Press, Ltd., New York (D. M. Knipe et al. eds., 4th ed., 2001), 996 (hereinafter "Fields Virology"), and the Encyclopedia of Virology (R. G. Webster et al. eds., Academic Press, 2nd ed., 1999), each of which is incorporated herein by reference in its entirety for all purposes.

Dengue (DEN) viruses are known among flaviviruses as agents of disease in humans. Dengue viruses comprise four known distinct, but antigenically related serotypes, named Dengue-1 (DEN-1 or Den-1), Dengue-2 (DEN-2 or Den-2), Dengue-3 (DEN-3 or Den-3), and Dengue-4 (DEN-4 or Den-4). Dengue virus particles are typically spherical and include a dense core surrounded by a lipid bilayer. Fields Virology, supra.

The genome of a dengue virus, like other flaviviruses, typically comprises a single-stranded positive RNA polynucleotide. Fields Virology, supra, at 997. The genomic RNA serves as the messenger RNA for translation of one long open reading frame (ORF) as a large polyprotein, which is processed co-translationally and post-translationally by cellular proteases and a virally encoded protease into a number of protein products. Id. Such products include structural proteins and non-structural proteins. A portion of the N-terminal of the genome encodes the structural proteins—the C protein, prM (pre-membrane) protein, and E protein—in the following order: C-prM-E. Id. at 998. The C-terminus of the C protein includes a hydrophobic domain that functions as a signal sequence for translocation of the prM protein into the lumen of the endoplasmic reticulum. Id. at 998-999. The prM protein is subsequently cleaved to form the structural M protein, a small structural protein derived from the C-terminal portion of prM, and the predominantly hydrophilic N-terminal "pr" segment, which is secreted into the extracellular medium. Id. at 999. The E protein is a membrane protein, the C-terminal portion of which includes transmembrane domains that anchor the E protein to the cell membrane and act as signal sequence for translocation of non-structural proteins. Id. The E protein is the major surface protein of the virus particle and is believed to be the most immunogenic component of the viral particle. The E protein likely interacts with viral receptors, and antibodies that neutralize infectivity of the virus usually recognize the E protein. Id. at 996. The M and E proteins have C-terminal membrane spanning segments that serve to anchor these proteins to the membrane. Id. at 998.

Dengue viruses are primarily transmitted to humans through the mosquito *Aedes aegypti*. There is a significant threat of dengue infection to people living in or visiting tropical areas. Indeed, an estimated 2.5 billion people live in areas at risk for transmission and over 100 million humans are infected each year. Infection with dengue virus is estimated to kill approximately 20-25,000 children each year.

An initial dengue virus infection is clinically manifested for most of the cases by dengue fever (DF), which is a self-limited fibril illness. Although rarely fatal, DF is characterized by often-severe disseminated body pain, headache, fever, rash, lymphadenopathy and leukopenia. Subsequent infection with a heterologous Dengue virus can lead to the much more severe to fatal disease of dengue hemorrhagic fever (DHF) or dengue shock syndrome (DSS). It is hypothesized that the presence of antibodies to the serotype causing the primary infection enhances the infection by a heterologous serotype in secondary infections. This phenomenon is referred to as antibody-dependent enhancement (ADE) of the disease.

Effective diagnosis of dengue virus is often problematic. All four dengue virus serotypes can be prevalent in one local area and it is therefore important to test a subject's serum samples simultaneously against all 4 dengue virus serotypes.

There is currently no specific treatment for dengue virus infections. Although the development of dengue virus vaccines has been ongoing for the past 50 years, no successful vaccine to dengue virus has been produced and no licensed dengue virus vaccine is yet available. A major challenge is to generate a tetravalent vaccine that induces neutralizing antibodies against all four strains of dengue to avoid ADE when the individual encounters viruses of two or more different serotypes. Vaccine strategies using a mixture of DEN 1-4 attenuated viruses have been largely unsuccessful, because the antigens from one type will tend to dominate or "mask" the others, producing an incomplete immune response across the four types.

There remains a need for molecules, compositions and methods for effectively diagnosing one or more dengue viruses, inducing, enhancing, or promoting an immune response to flaviviruses, particularly dengue viruses, and preferably to all four dengue virus serotypes, and prophylactically or therapeutically treating disorders or diseases related to one or more such viruses. The present invention provides such molecules, methods and compositions. These and other advantages of the invention, as well as additional inventive features, will be apparent from the description of the invention provided herein.

SUMMARY OF THE INVENTION

The invention provides novel recombinant, synthetic, mutant, and/or isolated polypeptides as described herein, fusion proteins comprising such polypeptides, and nucleic acids encoding such polypeptides and/or proteins, that are useful in promoting (e.g., inducing and/or enhancing) an immune response to one or more flaviviruses, particularly one or more dengue viruses, and detecting or diagnosing the presence of anti-*Flaviviridae* virus antibodies (e.g., anti-flavivirus antibodies) against at least one virus of the Flaviviridae family (e.g., members of the *Flavivirus* genus), and/or anti-dengue virus antibodies against at least one dengue virus in a biological sample.

In one aspect, for example, the invention provides recombinant, synthetic, mutant, and/or isolated polypeptides that each comprise an amino acid sequence that has at least about 80%, 83%, 85%, 86%, 87%, 88%, 89%, 90%, 91%, 92%, 93%, 94%, 95%, 96%, 97%, 98%, or 99% amino acid sequence identity to an amino acid sequence comprising a truncated recombinant, synthetic or mutant dengue virus envelope (E) protein polypeptide of the invention, such as at least one of any of SEQ ID NOS:1-49 and 153-155. Some such polypeptides induce an immune response in a subject, e.g., mammal or population of mammalian cells against at least one dengue virus, or dengue virus antigen, of at least one serotype selected from the group of dengue-1, dengue-2, dengue-3, and dengue-4 in vitro or ex vivo in cells and/or in vivo in a subject or cells or tissue thereof. Such a recombinant dengue E protein polypeptide is "truncated," since by comparison with the full length sequence of a wild-type (WT) dengue virus E protein, it lacks one or more amino acid residues from the C terminal of the full length E protein sequence. Usually, a truncated E protein lacks from about 3%, 5%, 10%, 15%, or 20% to about 25% of the C terminal amino acid residues of the full length E protein. Each such polypeptide comprises an immunogenic or antigenic amino acid sequence that is capable of inducing an immune response against one or more dengue viruses, or virus-like particle (VLP) or antigen thereof, of one or more, preferably multiple (e.g., 2, 3, or 4) serotypes. Some such polypeptides induce an immune response to all 4 dengue virus serotypes (a tetravalent immune response) or antigens, when expressed in, or delivered to, an animal or animal cell. Particular polypeptides having such characteristics advantageously are capable of inducing neutralizing antibodies against dengue viruses of multiple dengue virus serotypes upon expression in, or delivery to, an animal or animal cell(s), and, preferably, are able to induce a protective immune response against at least one of the four dengue virus serotypes in a subject, e.g., mammal, such as a primate or a human. Preferably, the recombinant polypeptide induces a protective immune response against all four dengue virus serotypes in a subject, e.g., mammal.

Such truncated E protein polypeptides of the invention induce an immune response in a subject against at least one dengue virus, or VLP or antigen thereof, of each of at least one, two, three, or four serotypes selected from the group of dengue-1, dengue-2, dengue-3, and dengue-4 that is about equal to or greater than an immune response induced in the subject against the at least one dengue virus of each of the at least one, two, three or four serotypes, or VLP or antigen thereof, by a wild-type truncated E protein of each said at least one dengue virus of each of the one, two, three or four serotypes, respectively, wherein said wild-type truncated E protein has an amino acid sequence length substantially equivalent to that of the recombinant, synthetic, or mutant polypeptide of the invention.

Each such recombinant, synthetic, or mutant polypeptides induces production of one or more types of antibodies that bind to at least one dengue virus of each of at least one, two, three or four serotypes. In one aspect of the invention, some such polypeptides induce production of a number or population of antibodies that bind to at least one dengue virus of each of at least one, two, three or four serotypes that is about equal to or greater than the number induced by a wild-type truncated E protein of the at least one dengue virus of each of the at least one, two, three or four serotypes, respectively.

Each such recombinant, synthetic, or mutant polypeptide of the invention induces or produces a titer of neutralizing antibodies against at least one dengue virus of each of at least one, two, three or four serotypes. Further, some such polypeptides induce or produce a titer of neutralizing antibodies against at least one dengue virus of each of at least one, two, three, or four serotypes that is about equal to or greater than a titer of neutralizing antibodies induced or produced against the at least one dengue virus of each of the at least one, two, three, or four serotypes by a wild-type truncated E protein of the at least one dengue virus of each of the at least one, two, three or four serotypes, respectively, wherein each said wild-type truncated E protein is selected from the group of SEQ ID NOS:338-341.

Some such recombinant, synthetic, or mutant polypeptides further comprise: (a) an amino acid sequence of at least about 150 amino acid residues that has at least about 70%, 75%, 80%, 85%, 86%, 87%, 88%, 89%, 90%, 91%, 92%, 93%, 94%, 95%, 96%, 97%, 98%, 99% or more amino acid sequence identity to at least one of SEQ ID NOS:117-126 fused to the N-terminus of the amino acid sequence of the recombinant or synthetic polypeptide; (b) an amino acid sequence of at least about 40 amino acid residues that has at least about 70%, 75%, 80%, 85%, 86%, 87%, 88%, 89%, 90%, 91%, 92%, 93%, 94%, 95%, 96%, 97%, 98%, 99% or more amino acid sequence identity to at least one of SEQ ID NOS:127-136 fused to the C-terminus of the amino acid sequence of the recombinant or synthetic polypeptide; or (c) the amino acid sequence of (a) and the amino acid sequence of (b).

The invention also provides a recombinant, synthetic, or mutant truncated or non-truncated dengue virus envelope protein, wherein the recombinant or synthetic polypeptide is encoded a nucleic acid comprising a polynucleotide sequence selected from the group of: (a) a polynucleotide sequence having at least about 70%, 75%, 80%, 85%, 86%, 87%, 88%, 89%, 90%, 91%, 92%, 93%, 94%, 95%, 96%, 97%, 98%, 99% or more nucleotide sequence identity to at least one polynucleotide sequence selected from the group of SEQ ID NOS:285-330 or a complementary polynucleotide sequence thereof; (b) a RNA polynucleotide sequence comprising a DNA sequence selected from the group of SEQ ID NOS:285-330 in which all of the thymine nucleotide residues in the DNA sequence are replaced with uracil nucleotide residues or a complementary RNA polynucleotide sequence thereof; (c) a RNA polynucleotide sequence that has at least about 70, 75, 80, 85, 86, 87, 88, 89, 90, 91, 92, 93, 94, 95, 96, 97, 98, 99% nucleotide sequence identity to at least one RNA polynucleotide sequence of (b) or a complementary RNA polynucleotide sequence thereof; (d) a polynucleotide sequence that hybridizes under at least stringent conditions over substantially the entire length of a polynucleotide sequence of (a)-(c); (e) a polynucleotide sequence which would hybridize under at least stringent conditions over substantially the entire length of a polynucleotide sequence of any of (a)-(d) but for the degeneracy of the genetic code; and (f) a polynucleotide sequence that possesses any combination of the features of the polynucleotide sequences of (a)-(e); or a complementary sequence of any thereof.

In another aspect, the invention provides isolated, recombinant, synthetic, or mutant polypeptides that each comprise an amino acid sequence that has at least about 70%, 75%, 80%, 85%, 86%, 87%, 88%, 89%, 90%, 91%, 92%, 93%, 94%, 95%, 96%, 97%, 98%, or 99% or more amino acid sequence identity to the amino acid sequence of at least one of SEQ ID NOS:65-116. Each such polypeptide typically comprises a recombinant, synthetic, or mutant dengue virus antigen comprising a PRM15/truncated E polypeptide. Such PRM15/truncated E protein polypeptide comprises a first amino acid sequence comprising a methionine at the N terminus fused to a second recombinant, mutant, or synthetic amino acid sequence comprising about 15 amino acid residues that may correspond to about the last 15 amino acids of the C terminal of a recombinant, synthetic or mutant dengue virus prM protein. The C terminus of the second amino acid sequence is fused in turn to the N terminus of a 3rd sequence which comprises a recombinant, mutant or synthetic truncated dengue virus E protein. The truncated E protein is deemed "truncated," since by comparison with a WT full length dengue virus E protein, it lacks one or more amino acids at the C terminus of the E protein. A truncated E protein may comprise about 75, 80, 85 or 90% E protein, said 75, 80, 85, or 90% E protein representing a portion of the E protein that comprises about 75, 80, 85, or 90%, respectively, of its length starting from amino acid 1 at its N-terminus. Such recombinant or synthetic PRM15/truncated E polypeptide induces an immune response against at least one dengue virus of at least one serotype, or VLP or antigen thereof.

Some such PRM15/truncated E polypeptides induce an immune response in a subject against at least one dengue virus of one serotype that is about equal to or greater than the immune response induced in the mammal against the same dengue virus of the same serotype by a PRM15/truncated E protein derived from the dengue virus serotype. Some such PRM15/truncated E polypeptides induce an immune response in a subject against each of at least 2 dengue viruses of 2 different serotypes that is about equal to or greater than the immune response induced in the subject against each of these 2 dengue viruses of different serotypes by a PRM15/truncated E protein made from either of the two serotypes. Some such PRM15/truncated E polypeptides each induce an immune response against each of at least three dengue viruses of three different serotypes that is about equal to or greater than the immune response induced in such cell against these three dengue viruses of three different serotypes by a PRM15/truncated E protein derived from any of the three serotypes. Some such PRM15/truncated E polypeptides induce an immune response in a subject against each of at least 4 dengue viruses of four different serotypes that is about equal to or greater than the immune response induced in such cell against these 4 dengue viruses of four different serotypes by a PRM15/truncated E protein derived from any of the four serotypes. In one aspect, a WTPRM15/truncated E protein polypeptide is selected from SEQ ID NOS:149-152.

PRM15/truncated E polypeptides are capable of inducing production of a population of antibodies comprising one or more types of antibodies that bind to at least one dengue virus of each of the at least 1, 2, 3 or 4 serotypes. Some such polypeptides induce the production of a population or number of antibodies that bind to at least one dengue virus of each of at least one, two, three or four serotypes that is about equal to or greater than is induced by the wild-type PRM15/truncated E protein polypeptide of each of the at least one, two, three, or four serotypes.

Furthermore, recombinant, synthetic, or mutant PRM15/truncated E polypeptides induce the production of a population of antibodies that bind more specifically to at least one dengue virus of each of at least one, two, three or four serotypes than is induced by the wild-type PRM15/truncated E polypeptide of the at least one dengue virus of each of the at least one, two, three, or four serotypes, respectively, wherein each said wild-type PRM15/truncated E polypeptide is selected from SEQ ID NOS:149-152.

In one aspect, recombinant, synthetic, or mutant PRM15/truncated E polypeptides induce the production of a titer of neutralizing antibodies against at least one dengue virus of each of at least one, two, three, or four serotypes. In a particular aspect, some of these recombinant, synthetic, or mutant PRM15/truncated E polypeptides induce the production of a titer of neutralizing antibodies against at least one dengue virus of each of at least one, two, three, or four serotypes that is about equal to or greater than a titer of neutralizing antibodies induced in the subject against the at least one dengue virus of each of at least one, two, three, or four serotypes, respectively, by a corresponding wild-type PRM15/truncated E polypeptide ("WT PRM15/truncated E fusion protein") of the at least one dengue virus of each of the at least one, two, three or four serotypes, wherein each said WT PRM15/truncated E protein polypeptide is selected from SEQ ID NOS:149-152. The sequence of SEQ ID NO:149, for example, comprises the following amino acid sequence: a methionine as the first amino acid residue, the last 15 amino acids from the C terminus of the prM sequence of WT DEN-1, and a truncated amino acid sequence of DEN-1 envelope protein, which is termed "truncated" because it excludes a number of amino acid residues from the C terminus of the envelope protein of DEN-1. For example, in one embodiment, about 11-14% (and preferably about 13%) of the amino acid residues of the C terminus of the E protein of Den-1 were excluded.

The invention also provides recombinant, synthetic, or mutant PRM15/truncated E polypeptides, each encoded by a nucleic acid comprising a polynucleotide sequence selected from the group of: (a) a polynucleotide sequence having at least about 70%, 75%, 80%, 85%, 86%, 87%, 88%, 89%, 90%, 91%, 92%, 93%, 94%, 95%, 96%, 97%, 98%, 99% or more nucleic acid sequence identity to at least one polynucleotide sequence selected from the group of SEQ ID NOS:156-200, 235, 342, and 344, or a complementary polynucleotide sequence thereof; (b) a RNA polynucleotide sequence comprising a DNA sequence selected from the group of SEQ ID NOS:156-200, 235, 342, and 344 in which all of the thymine nucleotide residues in the DNA sequence are replaced with uracil nucleotide residues or a complementary RNA polynucleotide sequence thereof; (c) a RNA polynucleotide sequence that has at least about 70%, 75%, 80%, 85%, 86%, 87%, 88%, 89%, 90%, 91%, 92%, 93%, 94%, 95%, 96%, 97%, 98%, 99% or more nucleic acid sequence identity to at least one RNA polynucleotide sequence of (b) or a complementary RNA polynucleotide sequence thereof; (d) a polynucleotide sequence that hybridizes under at least stringent conditions over substantially the entire length of a polynucleotide sequence of (a)-(c); (e) a polynucleotide sequence which would hybridize under at least stringent conditions over substantially the entire length of a polynucleotide sequence of any of (a)-(d) but for the degeneracy of the genetic code; and (f) a polynucleotide sequence that possesses any combination of the features of the polynucleotide sequences of (a)-(e).

In another aspect, the invention provides recombinant, synthetic, mutant, and/or isolated polypeptides, each of which comprises an amino acid sequence that has at least about 70%, 75%, 80%, 85%, 86%, 87%, 88%, 89%, 90%, 91%, 92%, 93%, 94%, 95%, 96%, 97%, 98%, 99% or more amino acid sequence identity to an amino acid sequence of at least one of SEQ ID NOS:139-148, 236-253, 343, and 345. Each such polypeptide typically comprises a recombinant, synthetic, or mutant dengue virus antigen comprising a fusion protein comprising a C15/full length prM protein/full length E protein. C15/full length prM/full length E protein polypeptides induce an immune response in a subject against at least one dengue virus of each of at least one, two, three, or four dengue virus serotypes. Further, for some such polypeptides, the immune response induced against at least one dengue virus of each of at least 1, 2, 3 or 4 serotypes is about equal to or greater than an immune response induced in such cell against the at least one dengue virus of each of the at least 1, 2, 3 or 4 serotypes by a wild-type C15/full length prM/full length E fusion protein polypeptide of each of the at least one, two, three or four serotypes, respectively, wherein the corresponding wild-type C15/full length prM/full length E fusion protein is selected from SEQ ID NOS:227-230.

For C15/full length prM protein/full length E protein polypeptides, the immune response may comprise the production of antibodies that bind to at least one dengue virus of each of at least one, two, three or four serotypes. In addition, some such polypeptides may induce production of a number of antibodies that bind to at least one dengue virus of each of the at least one, two, three, or four serotypes that is about equal to or greater than that induced by a corresponding wild-type C15/full length prM/full length E fusion protein of each of the at least one, two, three, or four serotypes, respectively, wherein each wild-type C15/full length prM/full length E fusion protein is selected from SEQ ID NOS:227-230.

In another aspect, some such C15/full length prM/full length E fusion protein polypeptides of the invention induce or produce a titer of neutralizing antibodies against at least one dengue virus of each of at least one, two, three, or four dengue virus serotypes. Furthermore, some such polypeptides induce or produce a titer of neutralizing antibodies in a subject against at least one dengue virus of each of at least one, two, three, or four serotypes that is about equal to or greater than a titer of neutralizing antibodies induced or produced in the subject against the at least one dengue virus of each of at least one, two, three, or four serotypes by a wild-type C15/full length prM/full length E fusion protein polypeptide of the at least one dengue virus of each of the at least one, two, three, or four serotypes, respectively, wherein each said wild-type C15/full length prM/full length E fusion protein polypeptide is selected from SEQ ID NOS:227-230.

The invention also provides recombinant, synthetic, or mutant C15/full length prM/full length E fusion protein polypeptides, wherein each such polypeptide is encoded by a nucleic acid comprising a polynucleotide sequence selected from the group of: (a) a polynucleotide sequence having at least about 80%, 85%, 90%, 93%, 95%, 98% or more nucleic acid sequence identity to at least one polynucleotide sequence selected from the group of SEQ ID NOS:201-210, 254-271, 342, and 344, or a complementary polynucleotide sequence thereof; (b) a RNA polynucleotide sequence comprising a DNA sequence selected from the group of SEQ ID NOS:201-210 254-271, 342, and 344 in which all of the thymine nucleotide residues in the DNA sequence are replaced with uracil nucleotide residues or a complementary RNA polynucleotide sequence thereof; (c) a RNA polynucleotide sequence that has at least about 70%, 75%, 80%, 85%, 86%, 87%, 88%, 89%, 90%, 91%, 92%, 93%, 94%, 95%, 96%, 97%, 98%, 99% or more nucleic acid sequence identity to at least one RNA polynucleotide sequence of (b) or a complementary RNA polynucleotide sequence thereof; (d) a polynucleotide sequence that hybridizes under at least stringent conditions over substantially the entire length of a polynucleotide sequence of (a)-(c); (e) a polynucleotide sequence which would hybridize under at least stringent conditions over substantially the entire length of a polynucleotide sequence of any of (a)-(d) but for the degeneracy of the genetic code; and (f) a polynucleotide sequence that possesses any combination of the features of the polynucleotide sequences of (a)-(e).

In another aspect, the invention provides a composition comprising at least one recombinant, mutant, synthetic and/or isolated polypeptide or nucleic acid of the invention and an excipient or carrier, including a pharmaceutically acceptable carrier or excipient.

In one aspect, the invention provides a composition comprising at least one recombinant, mutant, synthetic and/or isolated polypeptide comprising an amino acid sequence selected from the group of SEQ ID NOS:1-49, 65-116, 139-148, 153-155, 236-253, 343, and 345, or an antigenic or immunogenic polypeptide fragment thereof, that induces an immune response in a subject against at least one dengue virus of at least one virus serotype that is about equal to or greater than the immune response induced by a antigenic or immunogenic polypeptide fragment of the at least one dengue virus of the at least one serotype; and an excipient or carrier.

In yet another aspect, the invention provides an isolated, recombinant, mutant, or synthetic nucleic acid comprising a polynucleotide sequence selected from the group of: (a) a polynucleotide sequence having at least about 70%, 75%, 80%, 85%, 86%, 87%, 88%, 89%, 90%, 91%, 92%, 93%, 94%, 95%, 96%, 97%, 98%, 99% or more nucleic acid sequence identity to a sequence selected from the group of SEQ ID NOS:211-218 or a complementary polynucleotide sequence thereof; (b) a RNA polynucleotide sequence having at least about 70%, 75%, 80%, 85%, 86%, 87%, 88%, 89%, 90%, 91%, 92%, 93%, 94%, 95%, 96%, 97%, 98%, 99% or more nucleic acid sequence identity to a DNA sequence selected from the group of SEQ ID NOS:211-218 in which all of the thymine nucleotide residues in the DNA sequence are replaced with uracil nucleotide residues or a complementary RNA polynucleotide sequence thereof; and (c) a polynucleotide sequence that hybridizes under at least stringent conditions over substantially the entire length of a polynucleotide sequence of (a) or (b), or a complementary sequence thereof.

In another aspect, the invention includes an isolated, recombinant, mutant, or synthetic nucleic acid comprising a polynucleotide sequence selected from the group of: (a) a polynucleotide sequence comprising a nucleotide sequence having at least about 70%, 75%, 80%, 85%, 86%, 87%, 88%, 89%, 90%, 91%, 92%, 93%, 94%, 95%, 96%, 97%, 98%, 99% or more nucleic acid sequence identity to a sequence selected from the group of SEQ ID NOS:285-330, or a complementary polynucleotide sequence thereof; (b) a polynucleotide sequence encoding a polypeptide selected from SEQ ID NOS:1-49 and 153-155, or a complementary polynucleotide sequence thereof; (c) a RNA polynucleotide sequence having at least about 70%, 75%, 80%, 85%, 86%, 87%, 88%, 89%, 90%, 91%, 92%, 93%, 94%, 95%, 96%, 97%, 98%, 99% or more sequence identity to a DNA sequence selected from the group of SEQ ID NOS:285-330 in which all of the thymine nucleotide residues in the DNA sequence are replaced with uracil nucleotide residues, or a complementary RNA polynucleotide sequence thereof; (d) a polynucleotide sequence that hybridizes under at least stringent conditions over substantially the entire length of a polynucleotide sequence of (a)-(c); (e) a polynucleotide sequence which would hybridize under at least stringent conditions over substantially the entire length of a polynucleotide sequence of any of (a)-(d) but for the degeneracy of the genetic code; (f) a polynucleotide sequence having at least about 70%, 75%, 80%, 85%, 86%, 87%, 88%, 89%, 90%, 91%, 92%, 93%, 94%, 95%, 96%, 97%, 98%, 99% or more sequence identity to at least one polynucleotide sequence selected from the group of SEQ ID NOS:285-330, or a complementary polynucleotide sequence thereof wherein said polynucleotide sequence encodes a polypeptide that induces an immune response in a subject against at least one dengue virus of at least one serotype selected from dengue-1, dengue-2, dengue-3, and dengue-4 that is about equal to or greater than an immune response induced in the subject against the at least one dengue virus of the at least one serotype by a wild-type truncated envelope (E) protein of at least one dengue virus of the at least one serotype, wherein said wild-type truncated E protein is selected from the group of SEQ ID NOS:338-341; and (g) a polynucleotide sequence that possesses any combination of the features of the polynucleotide sequences of (a)-(f). The invention also provides a composition comprising an excipient or carrier and at least one nucleic acid of the invention, including, e.g., at least one polynucleotide sequence as defined by any of (a)-(g) above.

Also provided are isolated, recombinant, mutant, and/or synthetic nucleic acids that each comprise a polynucleotide sequence selected from the group of: (a) a polynucleotide sequence having at least about 70%, 75%, 80%, 85%, 86%, 87%, 88%, 89%, 90%, 91%, 92%, 93%, 94%, 95%, 96%, 97%, 98%, 99% or more sequence identity to a sequence selected from the group of SEQ ID NOS:156-200, 235, 342, and 344, or a complementary polynucleotide sequence thereof; (b) a polynucleotide sequence encoding a polypeptide selected from SEQ ID NOS:65-116, or a complementary polynucleotide sequence thereof; (c) an RNA polynucleotide sequence having at least about 70%, 75%, 80%, 85%, 86%, 87%, 88%, 89%, 90%, 91%, 92%, 93%, 94%, 95%, 96%, 97%, 98%, 99% or more sequence identity to a DNA sequence selected from the group of SEQ ID NOS:156-200, 235, 342, and 344, in which all of the thymine nucleotide residues in the DNA sequence are replaced with uracil nucleotide residues, or a complementary RNA polynucleotide sequence thereof; (d) a polynucleotide sequence that hybridizes under at least stringent conditions over substantially the entire length of a polynucleotide sequence of (a)-(c); (e) a polynucleotide sequence which would hybridize under at least stringent conditions over substantially the entire length of a polynucleotide sequence of any of (a)-(d) but for the degeneracy of the genetic code; (f) a polynucleotide sequence or fragment thereof having at least about 70%, 75%, 80%, 85%, 86%, 87%, 88%, 89%, 90%, 91%, 92%, 93%, 94%, 95%, 96%, 97%, 98%, 99% or more sequence identity to at least one polynucleotide sequence selected from the group of SEQ ID NOS:156-200, 235, 342, and 344, or a complementary polynucleotide sequence thereof, wherein said polynucleotide sequence or fragment thereof encodes a polypeptide that induces an immune response in a subject against at least one dengue virus of at least one serotype selected from DEN-1, DEN-2, DEN-3, and DEN-4 that is about equal to or greater than an immune response induced in the subject against the at least one dengue virus of the at least one serotype by a wild-type truncated envelope (E) protein of at least one dengue virus of the at least one serotype, wherein said wild-type truncated E protein is selected from any of SEQ ID NOS:149-152; and (g) a polynucleotide sequence that possesses any combination of features of the sequences of (a)-(f).

In another aspect, the invention provides isolated, recombinant, mutant, and/or synthetic nucleic acids that each comprise a polynucleotide sequence selected from the group of: (a) a polynucleotide sequence having at least about 70%, 75%, 80%, 85%, 86%, 87%, 88%, 89%, 90%, 91%, 92%, 93%, 94%, 95%, 96%, 97%, 98%, 99% or more sequence identity to a sequence selected from the group of SEQ ID NOS:201-210, 254-271, 342, and 344, or a complementary polynucleotide sequence thereof; (b) a polynucleotide sequence encoding a polypeptide selected from SEQ ID NOS:139-148, 236-253, 343, and 345 or a complementary polynucleotide sequence thereof; (c) a RNA polynucleotide sequence having at least about 70%, 75%, 80%, 85%, 86%, 87%, 88%, 89%, 90%, 91%, 92%, 93%, 94%, 95%, 96%, 97%, 98%, 99% or more sequence identity to a DNA sequence selected from the group of SEQ ID NOS:201-210, 254-271, 342, and 344 in which all of the thymine nucleotide residues in the DNA sequence are replaced with uracil nucleotide residues or a complementary RNA polynucleotide sequence thereof; (d) a polynucleotide sequence that hybridizes under at least stringent conditions over substantially the entire length of a polynucleotide sequence of (a)-(c); (e) a polynucleotide sequence which would hybridize under at least stringent conditions over substantially the entire length of a polynucleotide sequence of any of (a)-(e) but for the degeneracy of the genetic code; (f) a polynucleotide sequence, or fragment thereof, having at least about 70%, 75%, 80%, 85%, 86%, 87%, 88%, 89%, 90%, 91%, 92%, 93%, 94%, 95%, 96%, 97%, 98%, 99% or more sequence identity to at least one polynucleotide sequence selected from the group of SEQ ID NOS:201-210, 254-271, 342, and 344, or a complementary polynucleotide sequence thereof, wherein said polynucleotide sequence or fragment thereof encodes a polypeptide that induces an immune response in a subject against at least one dengue virus of at least one serotype selected from DEN-1, DEN-2, DEN-3, and DEN-4 that is about equal to or greater than an immune response induced in the subject against the at least one dengue virus of the at least one serotype by a WT truncated envelope (E) protein of at least one dengue virus of the at least one serotype, wherein said WT truncated E protein is selected from the group of SEQ ID NOS:227-230; and (g) a polynucleotide sequence that possesses any combination of the features of the polynucleotide sequences of (a)-(f).

Other advantageous features of the aforementioned polypeptides and polynucleotides encoding such polypeptide include the ability to induce a protective immune response against one or more dengue viruses, preferably against dengue viruses of multiple virus serotypes, in a subject, such as, e.g., an animal, including a mammal, or cell(s) thereof. Other desirable features of such polypeptides include higher expression, higher secretion, and/or more or more specific antibody binding exhibited by such polypeptides with respect to wild-type dengue virus proteins, including, e.g., C15/full length prM/full length E fusion proteins, full length prM/full length E fusion proteins, PRM15/truncated E protein polypeptides, PRM15/full length E fusion protein, full length E or truncated E proteins, and/or one or more fragments of any thereof, as described herein.

The invention further provides fusion proteins comprising the aforementioned polynucleotides of the invention; vectors comprising one or more of the polynucleotides of the invention; cells comprising such polypeptides, vectors, polynucleotides, and fusion proteins; and pharmaceutical compositions comprising such polypeptides, polynucleotides, vectors, fusion proteins, and/or cells. Exemplary vectors provided by the invention include viral vectors, including, e.g., flaviviral vectors (including, e.g., attenuated flaviviral vectors comprising a polynucleotide of the invention in place of at least a portion of the flaviviral vector genome encoding a wild-type C15/full length prM/full length E protein, full length prM/full length E fusion protein, PRM15/truncated E protein polypeptide, PRM15/full length E fusion protein, full length E or truncated E protein, and/or fragments of any thereof) and nucleotide vectors, such as the plasmid vector pMaxVax10.1 (described in Example 1 and shown in FIGS. 1 and 2), which the inventors have discovered to be an effective gene delivery vehicle in mammalian hosts.

With respect to polynucleotides, the invention further provides, for example, a polynucleotide comprising a nucleic acid sequence of at least about 1200 nucleotides that has at least about 65%, 75%, 80%, 85%, or 90% nucleotide sequence identity with at least one of SEQ ID NOS:285-330, as well as polynucleotides which hybridize with such a polynucleotide, and polynucleotides comprising a sequence which is the complement of the nucleic acid sequence. In another aspect, the invention provides a nucleic acid comprising a sequence of at least about 1200 nucleotides that has at least about 70%, 75%, 80%, or 90% nucleotide sequence identity to at least one of SEQ ID NOS:211-214.

The invention also provides methods of promoting (inducing and/or enhancing) an immune response to a dengue virus in a subject (e.g., animal, such as a mammal) by administering polypeptides, fusion protein, polynucleotides, vectors, or cells of the invention as described herein. In some such methods, administration of an immunogenic or antigenic polypeptide of the invention (preferably, e.g., a polypeptide which induces a neutralizing antibody response against one or more dengue viruses of multiple virus serotypes) to a subject is followed by repeat administration at selected time periods, resulting in an improved immune response. Such "boosting" administration strategies also are advantageously performed in conjunction with the administration of a polynucleotide of the invention (e.g., prophylactic or therapeutic administration of an immunogen-encoding polynucleotide (e.g., DNA vaccine)) is preferably followed by subsequent administration of additional immunogen-encoding or antigen-encoding polynucleotide of the invention and/or an immunogenic or antigenic polypeptide of the invention).

In another aspect, the invention provides a composition comprising a library of at least two recombinant or synthetic nucleic acids obtained by a method comprising recombining at least a first nucleic acid comprising a sequence selected from SEQ ID NOS:211-214, and at least a second nucleic acid, wherein the first and second nucleic acids differ from each other in two or more nucleotides, to produce a library of recombinant or synthetic nucleic acids.

The invention also includes a composition comprising a library of nucleic acids obtained by a method comprising recombining at least a first nucleic acid comprising a sequence selected from the group of SEQ ID NOS:215-218, and at least a second nucleic acid, wherein the first and second nucleic acids differ from each other in two or more nucleotides, to produce a library of recombinant or synthetic nucleic acids.

In another aspect, the invention provides a polypeptide which is specifically bound by polyclonal antisera raised against at least one antigen, the at least one antigen comprising an amino acid sequence selected from the group of SEQ ID NOS:1-49 and 153-155, or an antigenic or immunogenic fragment thereof, wherein said antigenic or immunogenic polypeptide fragment thereof that induces an immune response in a subject against at least one dengue virus of at least one virus serotype that is about equal to or greater than the immune response induced in the subject by a antigenic or immunogenic polypeptide fragment of the at least one dengue virus of the at least one serotype, wherein the polyclonal antisera is subtracted with at least one of: a truncated envelope protein selected from the group of SEQ ID NOS:338-341 and a truncated envelope protein comprising a known wild-type truncated dengue virus protein sequence, or an amino acid sequence fragment of a polypeptide sequence corresponding to a known wild-type dengue virus E protein, wherein said amino acid sequence fragment has a length substantially identical (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) to the truncated envelope protein of any of SEQ ID NOS:338-341.

The invention also provides polypeptides that are specifically bound by polyclonal antisera raised against at least one antigen, the at least one antigen comprising an amino acid sequence selected from the group of SEQ ID NOS:65-116, wherein the polyclonal antisera is subtracted with at least one of: a PRM15/truncated envelope protein selected from the group of SEQ ID NOS:149-152 and other amino acid sequences comprising known dengue virus PRM15/truncated envelope proteins.

The invention also provides polypeptides that are specifically bound by polyclonal antisera raised against at least one antigen, the at least one antigen comprising an amino acid sequence selected from the group of SEQ ID NOS:139-148, 236-253, 343, and 345, wherein the polyclonal antisera is subtracted with at least one of: a fusion protein comprising a C15/full length prM protein/full length E protein selected from the group of SEQ ID NOS:227-230 and other amino acid sequences comprising known dengue virus C15/full length prM protein/full length E protein PRM15/truncated envelope proteins.

The invention also includes an antibody or antisera produced by administering a truncated E polypeptide of the invention to a subject, which antibody or antisera specifically binds at least one antigen, the at least one antigen comprising a polypeptide comprising at least one amino acid sequence of SEQ ID NOS:1-49 and 153-155, which antibody or antisera does not specifically bind to at one or more of: the polypeptides of SEQ ID NOS:338-341 and a truncated envelope protein comprising a known wild-type truncated dengue virus protein sequence, or an amino acid sequence fragment of a polypeptide sequence corresponding to a known wild-type dengue virus E protein, wherein said amino acid sequence fragment has a length substantially identical (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) to the truncated envelope protein of any of SEQ ID NOS:338-341.

In another aspect, the invention provides an antibody or antisera produced by administering a truncated E polypeptide of the invention to a subject, which antibody or antisera specifically binds at least one antigen, the at least one antigen comprising a polypeptide comprising at least one amino acid sequence of SEQ ID NOS:65-116, which antibody or antisera does not specifically bind to at one or more of: a PRM15/truncated envelope protein selected from the group of SEQ ID NOS:149-152 and other amino acid sequences comprising known dengue virus PRM15/truncated envelope proteins. In yet another aspect, the invention provides an antibody or antisera produced by administering a truncated E polypeptide of the invention to a subject, which antibody or antisera specifically binds at least one antigen, the at least one antigen comprising a polypeptide comprising at least sequence of SEQ ID NOS:139-148, 235-253, 343, and 345, which antibody or antisera does not specifically bind to at one or more of: a fusion protein comprising a C15/full length prM protein/full length E protein selected from the group of SEQ ID NOS:227-230 and other amino acid sequences comprising known dengue virus C15/full length prM protein/full length E protein PRM15/truncated envelope proteins.

The invention also includes a pharmaceutical composition comprising at least one polypeptide of the invention (or at least one polynucleotide of the invention), and a pharmaceutically acceptable diluent, carrier, or excipient, wherein the at least one polypeptide (or polynucleotide) is present in an amount effective to provide a subject with protective immunity to at least one dengue virus of at least 1, 2, 3, or 4 dengue serotypes.

The invention also includes a pharmaceutical composition comprising at least one polypeptide of the invention (or at least one polynucleotide of the invention), and a pharmaceutically acceptable diluent, carrier, or excipient, wherein the at least one polypeptide (or polynucleotide) is present in an amount effective to induce an immune response (e.g., specific immune response) to at least one dengue virus of at least one, two, three, or four dengue virus serotypes and/or provide a subject with protective immunity to at least one dengue virus of at least one, two, three, or four dengue virus serotypes.

In another aspect, the invention provides a vaccine comprising at least one polypeptide of the invention (or polynucleotide of the invention) in an amount effective to provide a subject with protective immunity to at least one dengue virus of at least one, two, three, or four virus serotypes, and a pharmaceutically acceptable diluent, carrier, or excipient.

Also provided are methods of producing antibodies to at least one dengue virus of at least one serotype in a subject which comprise administering to said subject at least one nucleic acid or polypeptide of the invention, or a combination of both. Also included are methods of producing one or more antibodies that bind to at least one dengue virus of at least one serotype which comprise administering an effective amount of a polypeptide and/or nucleic acid of the invention, or a composition of either or both, to a population of cells such that the cells produce one or more antibodies that bind to at least one dengue virus of at least one serotype.

The invention further provides a method of producing a protective immune response against at least one dengue virus of each of at least one, two, three or four dengue virus serotypes in a subject, wherein the method comprises administering to the subject an amount effective of at least one nucleic acid of the invention sufficient to produce a protective immune response against challenge by the at least one dengue virus of each of the at least one, two, three, or four serotypes, respectively. For some such methods, the immune response is a protective antibody response, such that when said at least one nucleic acid is expressed, antibodies to at least one dengue virus of each of at least one, two, three, or four serotypes are generated in the subject at a level sufficient to produce a protective antibody response against challenge by the at least one dengue virus of each of the at least one, two, three of four serotypes, respectively.

In another aspect, the invention provides a method of inducing an immune response in a subject, such as a mammal, to at least one dengue virus of at least one serotype comprising administering an effective amount of at least one polypeptide of the invention, or an effective amount of a composition thereof, or both, to a subject. The invention also provides a method of inducing an immune response in a subject to at least one dengue virus of at least one serotype comprising administering an effective amount of at least one nucleic acid of the invention, or an effective amount of a composition thereof, or both, to a subject. The effective amount is usually an immunogenic or antigenic amount that facilitates induces a protective immune response or therapeutic or prophylactic treatment.

In addition, the invention provides a method of promoting an immune response in a subject to at least one dengue virus of at least one serotype comprising introducing at least one nucleic acid or polypeptide of the invention into a population of cells and delivering (e.g., implanting) the cells in a subject. The population of cells may initially have been obtained from the subject before introduction of the nucleic acid or polypeptide.

In another aspect, the invention provides a target nucleic acid which, but for the degeneracy of the genetic code, hybridizes under at least stringent conditions to a unique coding oligonucleotide which encodes a unique subsequence in a polypeptide selected from: SEQ ID NOS:65-116, wherein the unique subsequence is unique as compared to a known dengue virus antigen envelope polypeptide, any polypeptide selected from SEQ ID NOS:149-150, or a polypeptide encoded by any of SEQ ID NOS:231-234.

In another aspect, the invention provides a recombinant or synthetic polypeptide comprising an amino acid sequence that has at least about 90% amino acid sequence identity to an amino acid sequence comprising a polypeptide fragment of at least one polypeptide sequence selected from SEQ ID NOS: 236-253, wherein the polypeptide fragment does not include the first 16 amino acid residues of the selected polypeptide sequence of SEQ IDS:236-253, and wherein the recombinant or synthetic polypeptide induces an immune response in a subject or cells of the subject against at least one dengue virus of each of at least two serotypes selected from the group of dengue-1, dengue-2, dengue-3, and dengue-4 that is about equal to or greater than an immune response induced in the subject or cells thereof against the at least one dengue virus of the at least two serotypes by a wild-type envelope (E) protein of at least one dengue virus of each of the at least two serotypes selected from SEQ ID NO:338, 339, 340, and 341, respectively.

Also included is a recombinant or synthetic polypeptide comprising an amino acid sequence that has at least about 70%, 75%, 80%, 85%, 86%, 87%, 88%, 89%, 90%, 91%, 92%, 93%, 94%, 95%, 96%, 97%, 98%, 99% or more amino acid sequence identity to an amino acid sequence of at least one of SEQ ID NOS:1-49 and 153-155, wherein the recombinant or synthetic polypeptide induces an immune response in a subject or a population of cells thereof against at least one dengue virus of each of at least two serotypes selected from the group of dengue-1, dengue-2, dengue-3, and dengue-4 that is about equal to or greater than that induced by a WT E protein of each of said at least one dengue virus, respectively, wherein said WT E protein has an amino acid sequence length substantially equivalent or identical to that of the recombinant or synthetic polypeptide.

In another aspect, the invention provides a recombinant or synthetic polypeptide comprising an amino acid sequence that has at least about 70%, 75%, 80%, 85%, 86%, 87%, 88%, 89%, 90%, 91%, 92%, 93%, 94%, 95%, 96%, 97%, 98%, 99% or more amino acid sequence identity to an amino acid sequence of at least one of SEQ ID NOS:1-49 and 153-155, wherein the recombinant or synthetic polypeptide induces an immune response in a subject, e.g., mammal, or cells thereof, against at least one dengue virus of each of at least two serotypes selected from the group of dengue-1, dengue-2, dengue-3, and dengue-4 that is about equal to or greater than an immune response induced in the subject, or cells thereof, against each said at least one dengue virus of each of the at least two dengue serotypes induced by a WT truncated E protein of each of dengue-1, dengue-2, dengue-3, and dengue-4, respectively, wherein said WT truncated E protein has an amino acid sequence length substantially equivalent or identical to that of the recombinant or synthetic polypeptide.

In yet another aspect, the invention provides a recombinant or synthetic polypeptide comprising an amino acid sequence that has at least about 70%, 75%, 80%, 85%, 86%, 87%, 88%, 89%, 90%, 91%, 92%, 93%, 94%, 95%, 96%, 97%, 98%, 99% or more amino acid sequence identity to the amino acid sequence of at least one of SEQ ID NOS:65-116, wherein the recombinant or synthetic polypeptide induces an immune response in a subject or population of cells thereof, e.g., mammal or population of mammalian cells, against at least one dengue virus of each of at least two serotypes selected from the group of DEN-1, DEN-2, DEN-3, and DEN-4 that is about equal to or greater than an immune response induced in the subject (e.g., mammal or population of mammalian cells) against each said at least one dengue virus of each of the at least two serotypes by a WT PRM15/truncated E protein of each of DEN-1, DEN-2, DEN-3, and DEN-4, respectively, wherein each said WT PRM15/truncated E protein polypeptide is selected from SEQ ID NOS:149-152.

The invention further provides a recombinant or synthetic polypeptide comprising an amino acid sequence that has at least about 70%, 75%, 80%, 85%, 86%, 87%, 88%, 89%, 90%, 91%, 92%, 93%, 94%, 95%, 96%, 97%, 98%, 99% or more amino acid sequence identity to an amino acid sequence of at least one of SEQ ID NOS:139-148, 236-253, 343, and 345, wherein the recombinant or synthetic polypeptide induces an immune response in a subject or population of cells thereof against at least one dengue virus of each of at least two serotypes selected from the group of DEN-1, -2, -3, and -4 virus that is about equal to or greater than an immune response induced in the mammalian cell against the at least one dengue virus of each of the at least two serotypes by a WT C15/full length prM/full length E fusion protein of each of said at least two serotypes, wherein each said WT C15/full length prM/full length E fusion protein is selected from SEQ ID NOS:227-230.

Also included is a protein aggregate formed from a population of at least two recombinant or synthetic polypeptides of the invention. Such protein aggregate includes dimers, trimers, etc. and other multiples of the polypeptides of the invention, which polypeptides need not be identical.

Included are virus-like particles comprising of at least two polypeptides of the invention, which polypeptides need not be identical. Some such virus-like particles are formed from a population of at least two polypeptides selected from among the recombinant, mutant, or synthetic polypeptides. Some such virus-like particles are formed from expression of one or more nucleic acids encoding at least two polypeptides of the invention.

Also provided are viruses, including, e.g., attenuated viruses, comprising at least one of: (1) a nucleic acid of the invention; (2) a polypeptide of the invention; and/or (3) a vector of the invention. The virus may comprise a yellow fever (YF) virus that has been modified with a nucleic acid, polypeptide, and/or vector of the invention. Included is a chimeric virus comprising a dengue virus (e.g., DEN-2 or DEN-4) that comprises at least one polypeptide of the invention in place of or in addition to the respective dengue virus full length or truncated E protein, the respective dengue virus full length prM protein or fragment thereof (e.g., PRM15), and/or the respective dengue virus fusion protein comprising the native dengue virus C15/full length prM/full length envelope protein. Included is an attenuated or replication-deficient chimeric flavivirus (e.g., dengue virus or YF virus) or adenovirus, comprising at least one nucleic acid or polypeptide of the invention in place of the corresponding nucleic acid or polypeptide of the flavivirus or adenovirus, respectively.

Also provided is a DNA or RNA construct or a viable chimeric recombinant flavivirus, said DNA or RNA construct or chimeric recombinant flavivirus comprising a first region of nucleic acid encoding a recombinant protein(s) (e.g., PRM15/truncE, C15/full prM/full E, or prM & E proteins) of the invention) operably linked to a 2nd region of nucleic acid encoding non-structural proteins of a flavivirus (e.g., YF virus or DEN-2, DEN-4).

The invention also includes an integrated system comprising a computer or computer readable medium comprising a database comprising at least one sequence record, each said at least one sequence record comprising at least one character string corresponding to at least one polypeptide sequence selected from the group of SEQ ID NOS:1-49, 65-116, 139-148, 153-155, 236-253, 343, and 345, or at least nucleic acid sequence selected from the group of SEQ ID NOS:156-210, 235, 254-271, 285-330, 342, and 344, the integrated system further comprising a user input interface allowing a user to selectively view said at least one sequence record.

Also provided is a method of using a computer system to present information pertaining to at least one of a plurality of sequence records stored in a database, the sequence records each comprising at least one character string corresponding to SEQ ID NOS:1-49, 65-116, 139-148, 153-210, 235-271, 285-330, 342-345, the method comprising: (a) determining a list of at least one character string corresponding to at least one of the group of SEQ ID NOS:1-49, 65-116, 139-148, 153-210, 235-271, 285-330, 342-345, or a subsequence thereof; (b) determining which said at least one character string of the list is selected by a user; and (c) displaying each selected character string, or aligning each selected character string with an additional character string.

The invention further provides improved and novel methods and techniques for detecting and/or diagnosing the presence of antibodies against one, two, three or four dengue virus serotypes in a sample (including, e.g., a biological sample, such as a serum sample obtained from a subject, such as a animal, including, e.g., a mammal, including, e.g., a human at risk for dengue virus infection). The invention also provides methods and techniques for simultaneously detecting and/or diagnosing the presence of antibodies against one, two, three or four dengue virus serotypes in a single sample. The polypeptides of the invention, and the nucleic acids encoding them, can be used in this respect to detect or diagnose a biological sample for the presence of such antibodies. Advantageously, a composition comprising as little as about 10 µl of the aspirated supernatant of a cell culture transfected with a polynucleotide of the invention can serve as a uniform and suitable substrate for the simultaneous diagnosis or detection of antibodies against all four serotypes of dengue virus in a sample, such as, e.g., a biological sample, including a sample obtained from a subject, such as a mammal, including, e.g., human, at risk for dengue virus infection. The biological sample can be, e.g., a blood serum sample obtained from a subject.

In another aspect, the invention provides a method of diagnosing a sample for, or detecting in a sample, the presence of one or more antibodies that bind to at least one dengue virus of at least one serotype, the method comprising: (a) contacting the sample with at least one polypeptide of the invention under conditions such that if the sample comprises one or more antibodies that bind to the at one dengue virus, at least one anti-dengue virus antibody binds to the at least one polypeptide to form a mixed composition; (b) contacting the mixed composition with at least one affinity molecule that binds to an anti-dengue virus antibody; (c) removing unbound affinity-molecule from the mixed composition; and (d) diagnosing or detecting the presence or absence of one or more affinity molecules, wherein the presence of one or more affinity molecules is indicative of the presence of one or more antibodies that bind to the at least one dengue virus in the sample.

In addition, the invention provides a method of diagnosing a sample for, or detecting in a sample, the presence of at least one antibody that binds to a dengue virus of at least one serotype, said method comprising: (a) contacting the sample with at least one polypeptide of the invention under conditions such that if the sample comprises one or more antibodies that bind to the dengue virus, at least one anti-dengue virus antibody binds to the at least one polypeptide to form at least one antibody-polypeptide complex, and (b) diagnosing or detecting the presence or absence of the at least one antibody-polypeptide complex, wherein the presence of the at least one antibody-polypeptide complex is indicative of the presence of at least one antibody that binds to the dengue virus in the sample.

Methods of producing the above-described nucleic acids and polypeptides also are provided by the present invention. In general, the polynucleotides of the invention are advantageously prepared by standard nucleic acid synthesis techniques (e.g., polymerase chain reaction (PCR)-facilitated overlapping nucleic acid assembly). However, the invention also provides a method of performing recursive sequence recombination with selected nucleic acids of the invention and appropriate screening techniques to generate and identify novel dengue antigen-encoding nucleic acids. Methods of making polypeptides of the invention include the transfection or infection of cells, either in vitro, in vivo, or ex vivo, with the polynucleotides and/or vectors of the invention, in addition to standard synthetic protein synthesis techniques.

Numerous alternative, additional and/or more particular polynucleotides, polypeptides, fusion proteins, viruses, vectors, cells, cell cultures, compositions, transgenic animals, transdermal patches, methods of using nucleic acids and/or polypeptides of the invention, diagnostic and detection assays, methods and techniques provided by the invention are set forth below.

BRIEF DESCRIPTION OF THE DRAWINGS

FIG. 7 presents a comparison of ELISA OD values for antisera obtained from blood of mice injected with a pMaxVax10.1 vector comprising a parental dengue virus PRM15/ tE nucleic acid (encoding a WT DEN-1 DEN-2, DEN-3, or DEN-4 polypeptide sequence) or a select representative recombinant PRM15/tE nucleic acid encoding a recombinant PRM15/tE dengue virus antigen (Ag). Results using antisera obtained from mice injected with a mixture of four pMaxVax10.1 vectors, each vector including a nucleotide sequence encoding one of the four WT DEN-1 PRM15/tE, DEN-2PRM15/tE, DEN-3PRM15/tE, and DEN-4PRM15/tE antigens (i.e., pMaxVax10.1$_{DEN\text{-}3PRM15/tE\ CO}$, pMaxVax10.1$_{DEN\text{-}2PRM15/tE\ CO}$, pMaxVax10.1$_{DEN\text{-}3PRM15/tE\ CO}$, and pMaxVax10.1$_{DEN\text{-}4PRM15/tE\ CO}$), are also shown. The control ("pMV") is a pMaxVax10.1 vector that lacks a parental or recombinant PRM15/tE nucleic acid.

FIG. 8A illustrates the results of reciprocal 50% plaque reduction neutralization titers (PRNT) for sera obtained from mice at day 76 after the initial injection at day 0 with a representative pMaxVax10.1 DNA plasmid vector comprising either one of the four WT DEN-1PRM15/tE, DEN-2PRM15/tE, DEN-3PRM15/tE, and DEN-4PRM15/tE antigens, or a mix of these 4 wild-type antigens, or a recombinant nucleotide sequence of the invention corresponding to one of the following antigens: 18E9, 18D7, 16G11, 18H2, 16B4, 6E12, 2G11, 2/7, 15D4, and 18H6. FIG. 8B illustrates the results of reciprocal 50% plaque reduction neutralization titers (PRNT) for sera obtained from mice at day 76 after the initial injection at day 0 with a representative pMaxVax10.1 DNA plasmid vector comprising either one of the four WT DEN-1, DEN-2, DEN-3, and DEN-4 antigens in the C15/full prM/full E antigen format, or a mix of these 4 wild-type antigens, or a recombinant nucleotide sequence of the invention corresponding to one of the following C15/full prM/full E antigens: 5/21-D1, 2G11-D4, and 6E12-D4.

Figure 9:
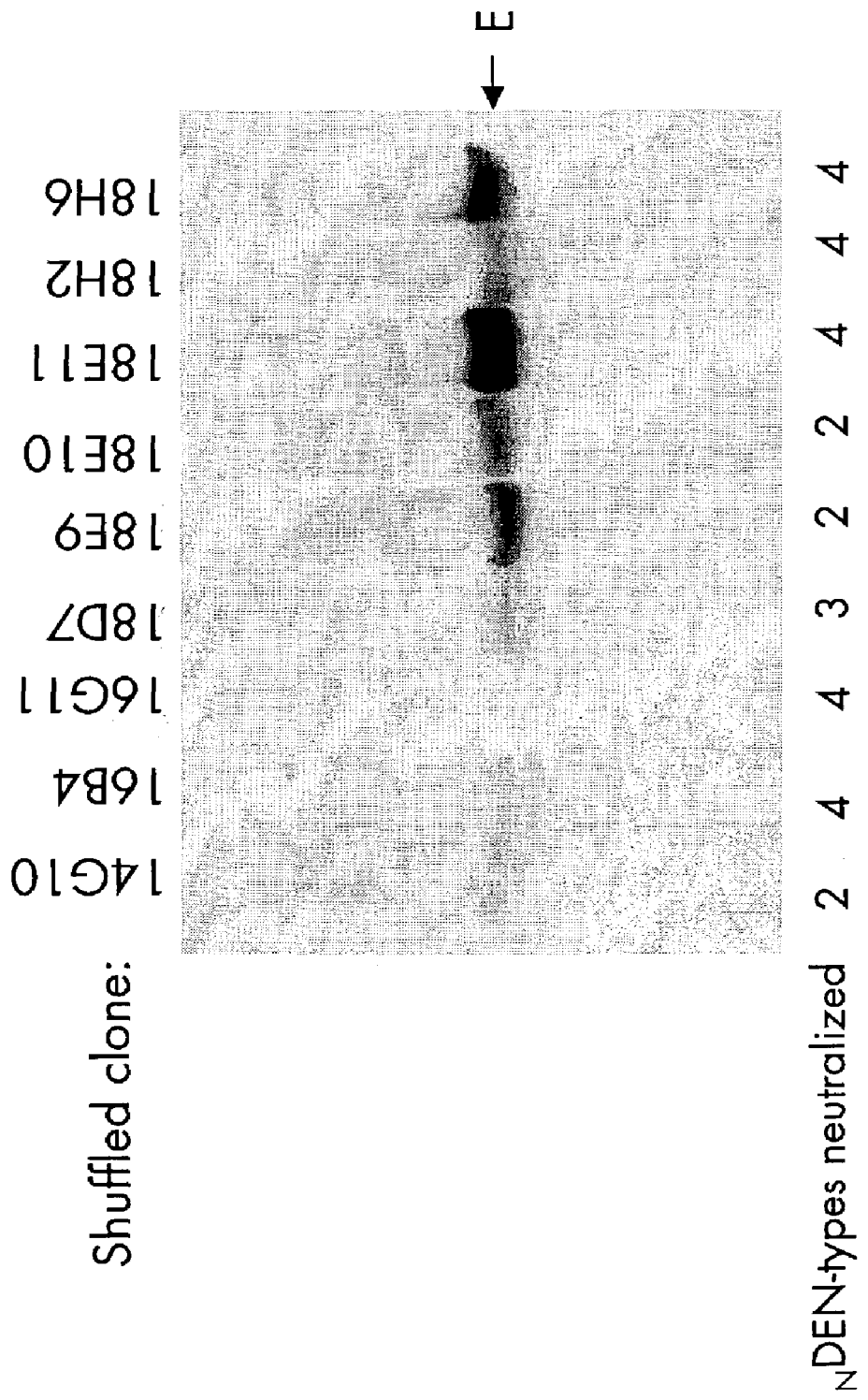

FIG. 9 shows a Western blot analysis of nine secreted recombinant dengue virus polypeptide antigens of the invention, each encoded by a recombinant polynucleotide of the invention, that induced a neutralizing antibody response against wild-type dengue viruses of at least two dengue virus serotypes in vivo. "E" refers to envelope protein, and the arrow to the right of the blot indicates the position of the E protein in the blot. For each recombinant antigen, the number of different serotypes neutralized by the antibody response induced by the antigen is shown. The PRNT results are shown in FIGS. 8A and 8B.

Figure 10:
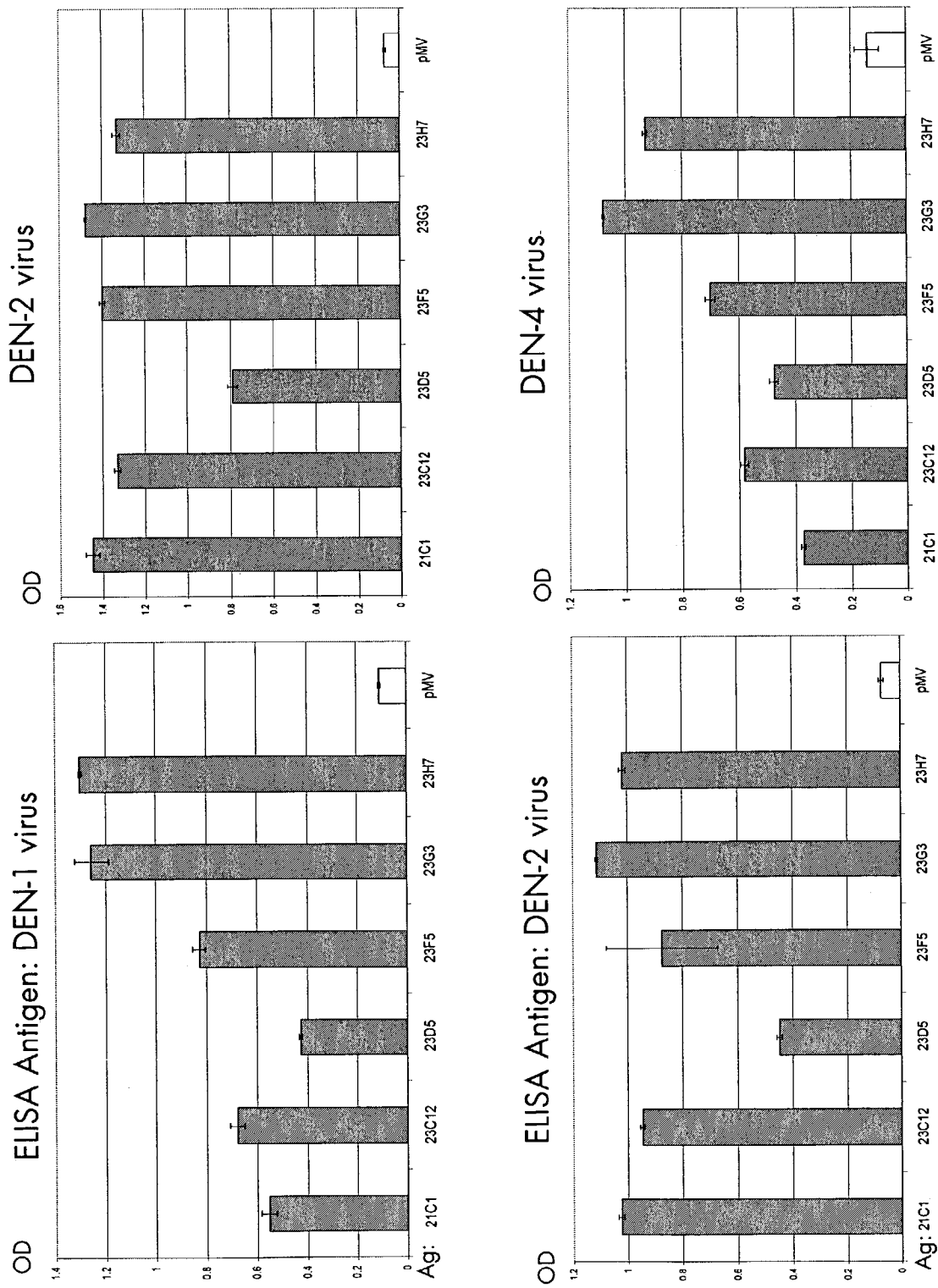

FIG. 10 provides OD graphs obtained by ELISA analyses of antisera obtained from mice, each of which had been injected with a pMaxVax10.1 vector comprising a recombinant nucleotide sequence. The recombinant nucleotide sequences were generated by recursive sequence recombination of the human codon optimized dengue virus sequences (e.g., SEQ ID NOS:215-218). Each such recombinant nucleotide sequence encoded a recombinant dengue virus antigen having the following format: C15 signal sequence/full length prM protein/full length E protein. A pMaxVax10.1$_{null}$ vector ("pMV") served as the control vector.

Figure 11:
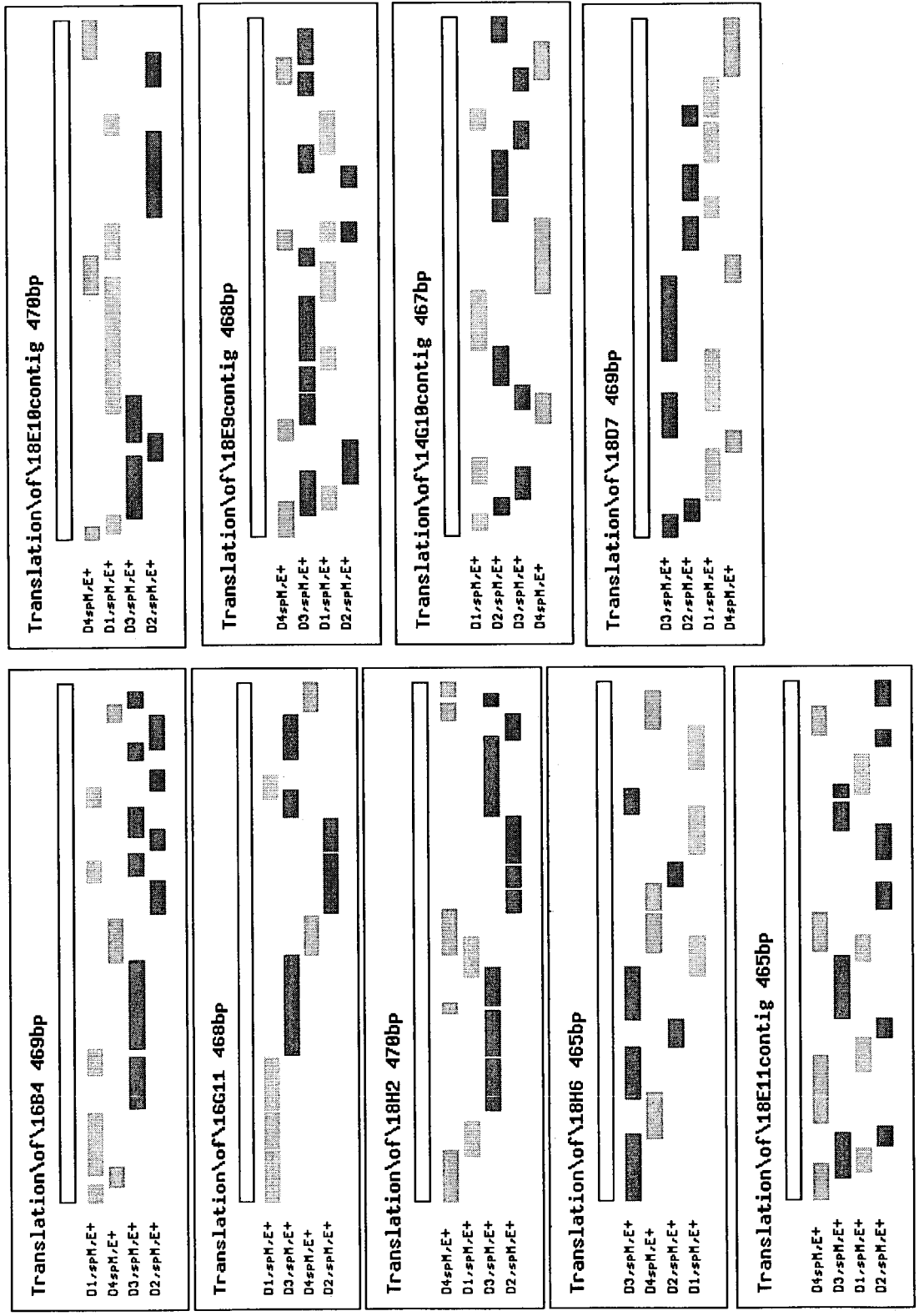

FIG. 11 shows the results of a sequence diversity analysis (e.g., chimerism) of amino acid sequences of representative recombinant PRM15/truncated E dengue virus antigens of the invention that are encoded by recombinant nucleic acids of the invention, as compared with sequences of the parental WT DEN-1 PRM15/tE, DEN-2 PRM15/tE, DEN-3 PRM15/ tE, and DEN-4 PRM15/tE proteins. This analysis confirms that these recombinant antigens include amino acid fragments or segments from all four parental WT protein sequences and thus constitute chimeras of the parental sequences.

Figure 12:
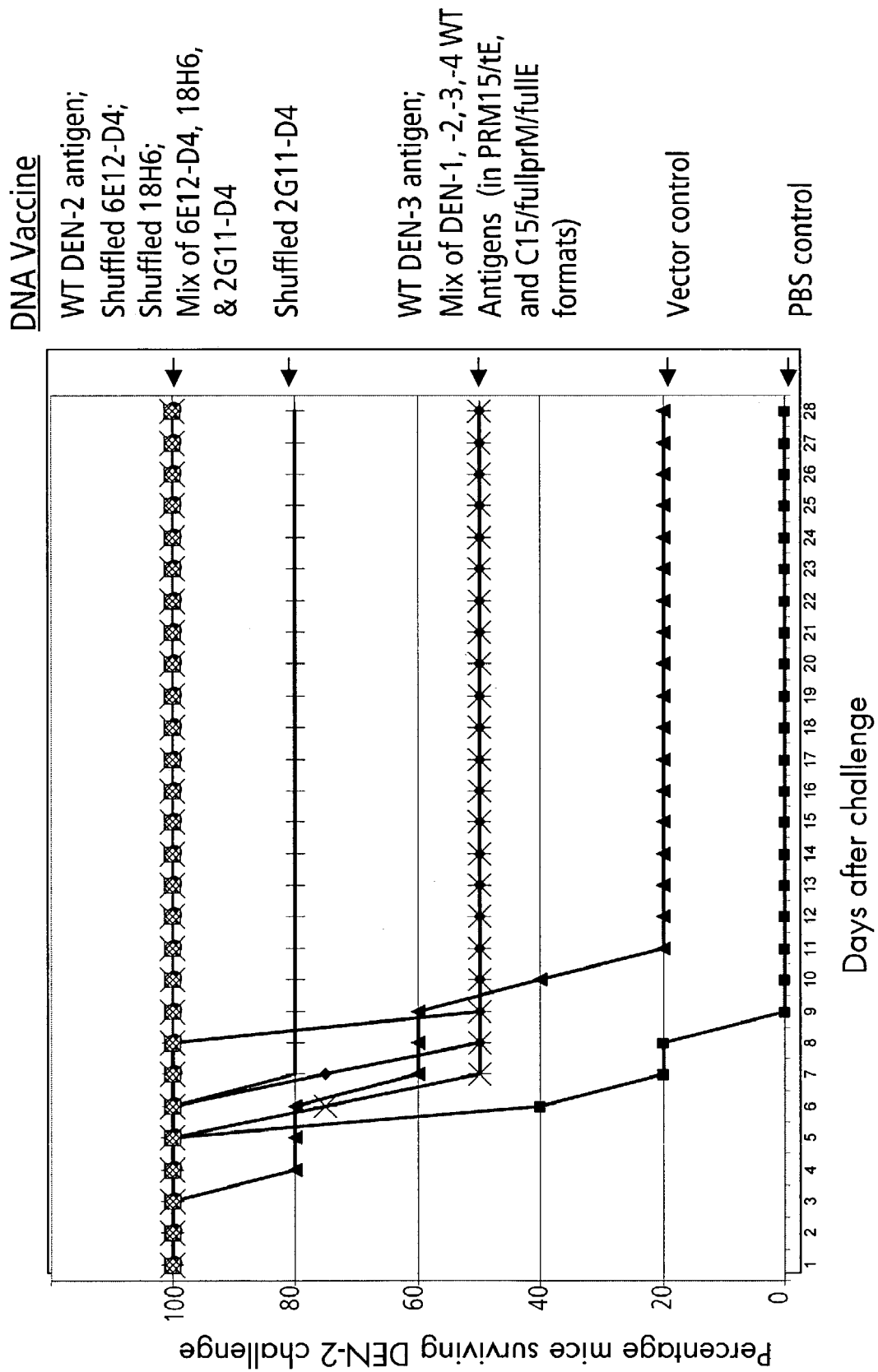

FIG. 12 is a graph showing the percentage of mice that have survived challenge with DEN-2 virus over a period of 28 days following immunization with a recombinant pMaxVax10.1 vector of the invention. In this experiment, a recombinant pMaxVax10.1 vector comprising one of the following three recombinant PRM15/tE nucleic acid sequences of the invention and a mixture of these three nucleic acid sequences were evaluated: SEQ ID NOS:235 (18H6), SEQ ID NOS:204 (2G11-D4) and SEQ ID NOS: 202 (6E12-D4). For comparison, some mice were injected with a pMaxVax10.1 vector comprising a WT DEN-2 PRM15/tE nucleic acid sequence and WT DEN-2 C15/full prM/full E, or a WT DEN-3 C15/full prM/full E nucleic acid sequence, as well as a mix of all four DEN-1-4 WT PRM15/tE and C15/full prM/full E. Mice injected with PBS or a pMaxVax10.1$_{null}$ vector served as control mice.

Figures 13A, 13B:
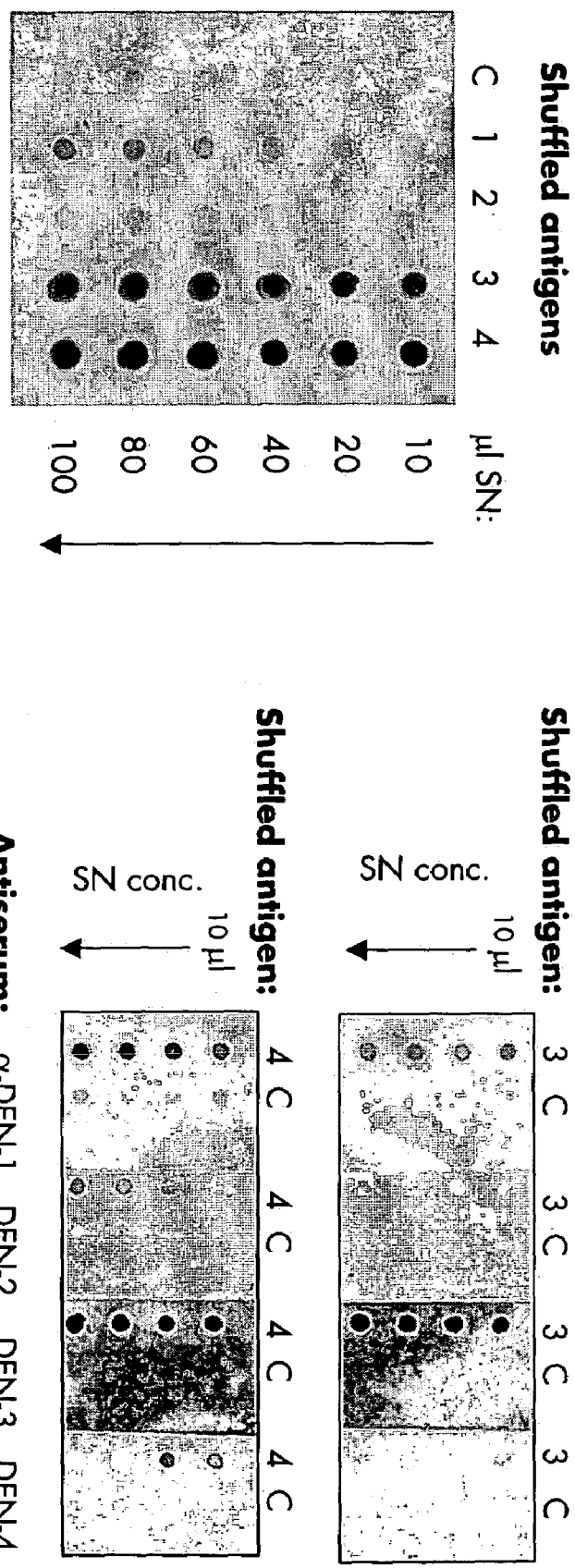

FIGS. 13A and 13B show dot blots of 10 µl to 100 µl of supernatant from 293 cells transfected with representative nucleic acids of the invention (e.g., 5/21 (SEQ ID NO:157), 2/7 (SEQ ID NO:156), 6E12 (SEQ ID NO:159) and 2G11 (SEQ ID NO:157) when reacted with mouse DEN-1, DEN-2, DEN-3, and DEN-4 antisera. FIG. 13A shows detection of DEN-specific antibodies in a mix of DEN-1 to –4 mouse serum with supernatants (SN) of shuffled antigen transfected cells as antigen source. FIG. 13B shows shuffled antigens 3 and 4 tested with DEN 1-4 antisera individually. 10 ml SN is sufficient for detection of all 4 type-specific dengue sera. Shuffled antigens: 1=5/21; 2=2/7; 3=6E12; 4=2G11; C=vector control.

Figure 14:
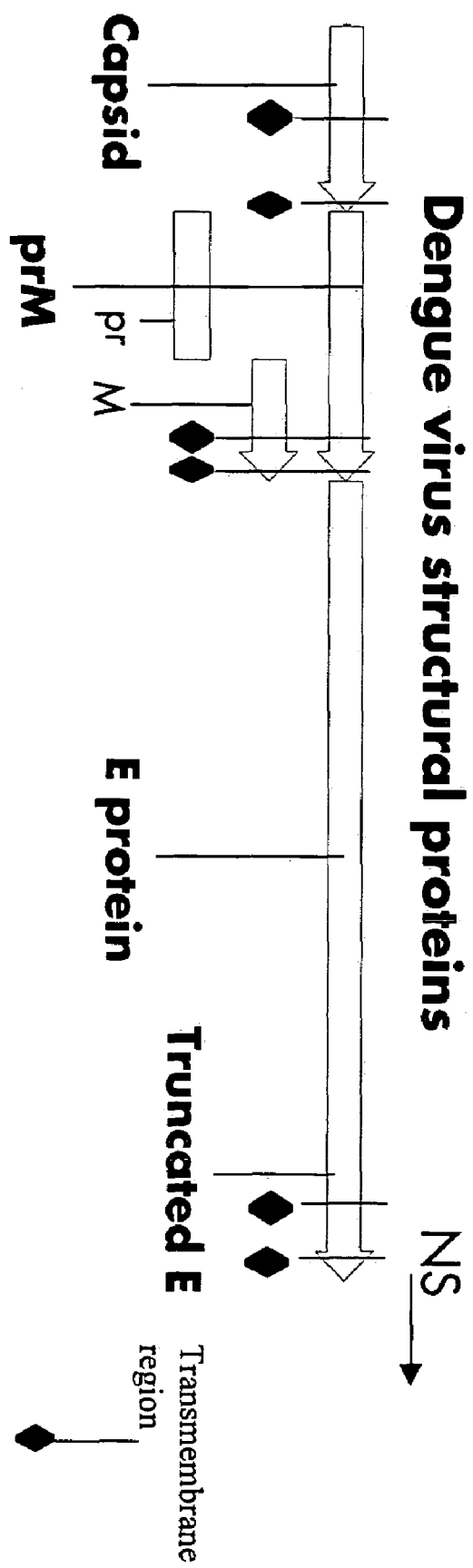

FIG. 14 is an exemplary graphical representation of a wild-type dengue virus gene and dengue virus structural proteins encoded therefrom (capsid, prM, and E proteins). FIG. 14 shows the dengue virus genome organization (11 kb, positive sense ss-RNA genome; expresses long polyproteins). The polyprotein is cleaved into structural capsid (C), membrane (prM), and envelope (E) proteins, and non-structural (NS) proteins. The protein prM is further cleaved into precursor (pr) and membrane (M).

Figure 15A:
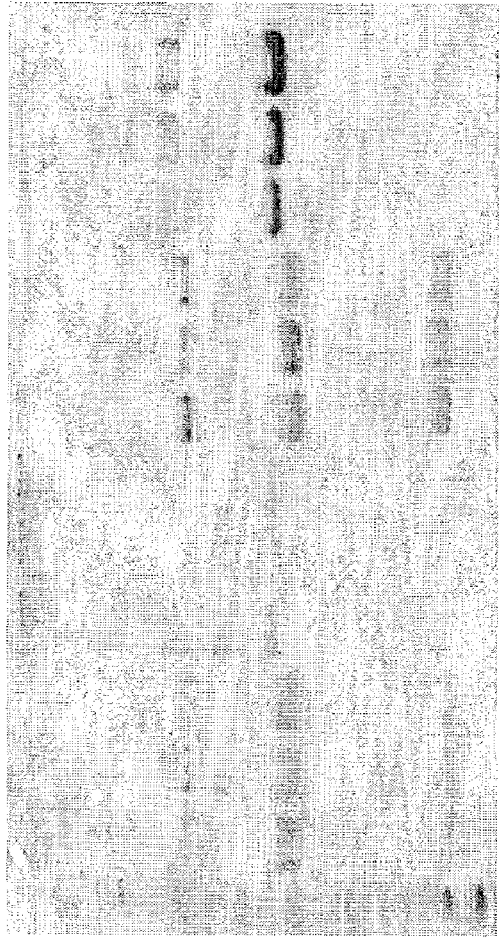
Figure 15B:
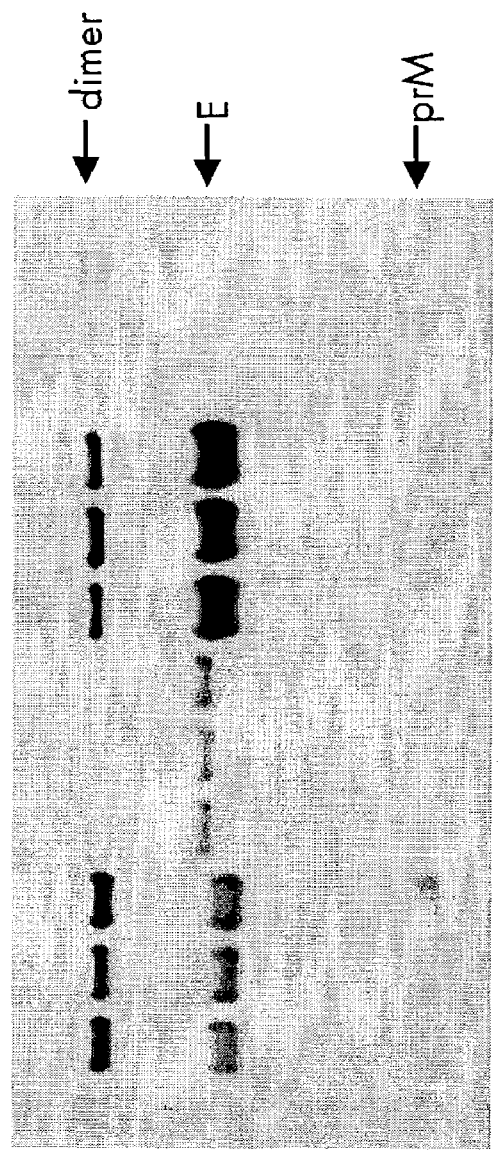

FIGS. 15A and 15B show DEN-3 WT in C15/full prM/full E protein format and selected recombinant polypeptides of the invention (18H6 in PRM15/truncated E format and 16G11-25B10 in C15/full prM/full E format) purified by centrifugation through 20%-60% sucrose gradients. The purified polypeptides are either stained with Coomassie Blue (15A) in a polyacrylamide (PAA) gel or with DEN-specific antibodies after Western Blot transfer to nitrocellulose filters (15B) using standard techniques (see, e.g., Rapley, R. and Walker, J. M. eds., MOLECULAR BIOMETHODS HANDBOOK (1998), Humana Press, Inc., Tijssen (1993) LABORATORY TECHNIQUES IN BIOCHEMISTRY AND MOLECULAR BIOLOGY—HYBRIDIZATION WITH NUCLEIC ACID PROBES [hereinafter Rapley and Walker, MOLECULAR BIOMETHODS HANDBOOK]. E represents "envelope" protein. Bovine serum albumin (BSA) was used as a control in the gel and Western Blot. Bands suggesting formation of a dimer polypeptide for each of DEN-3 C15/full prM/full E and 16G11-25B10 are shown.

Figure 16:
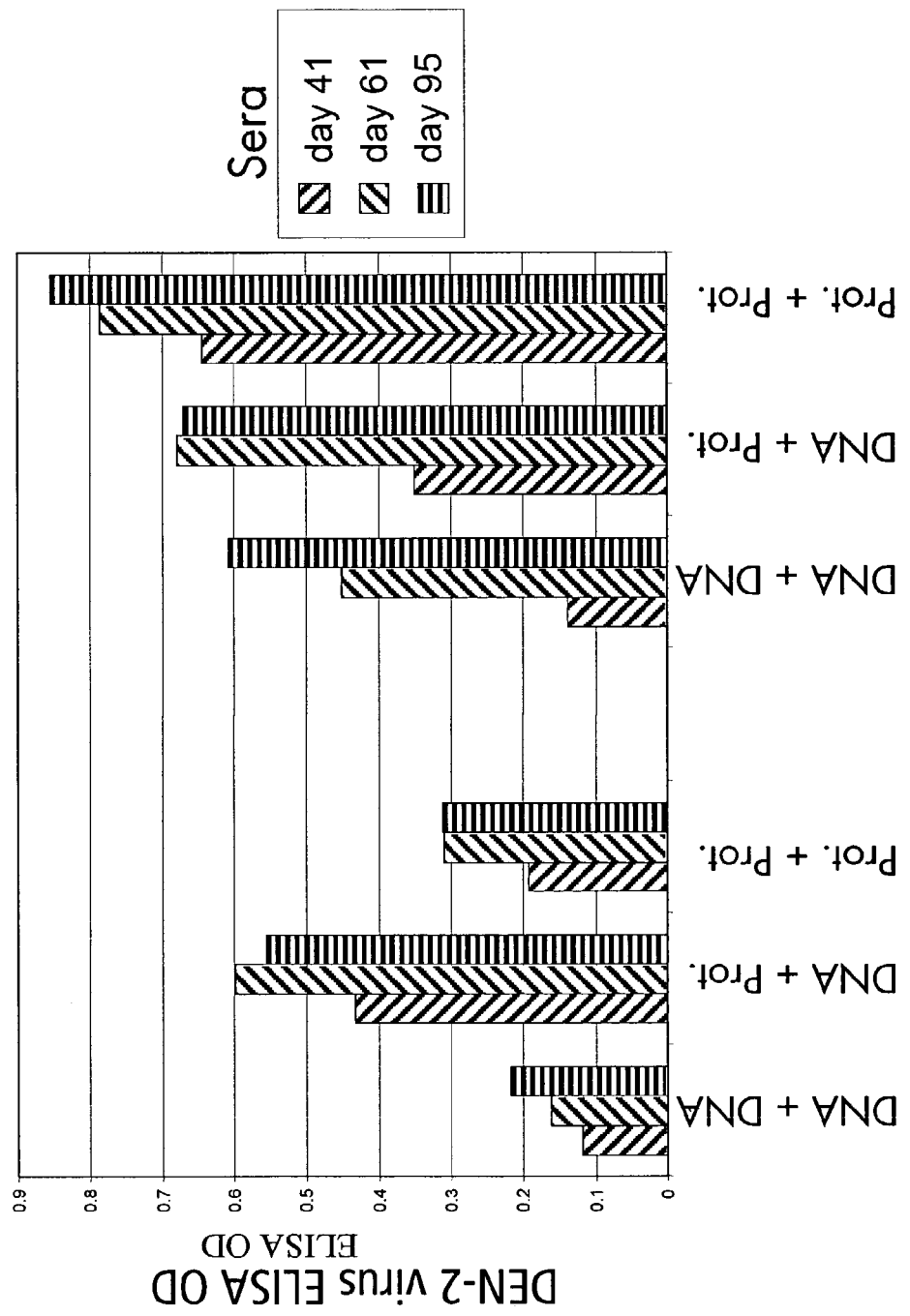

FIG. 16 presents a comparison of ELISA OD values for antisera obtained from blood of mice immunized by injection with either a pMaxVax10.1 vector encoding one of the following recombinant polypeptide antigens of the invention (18H6 (SEQ ID NO:235) or 16G11-25B10 (SEQ ID NO:255)) or by sucrose gradient purified polypeptides of the invention (18H6 (SEQ ID NO:110) or 16G11-25B10 (SEQ ID NO:251)) in alum adjuvant. The mice received 2 booster immunizations in 3-week intervals, either with a pMaxVax10.1 vector encoding one of the following recombinant polypeptide antigens of the invention (e.g., DNA+DNA), or with polypeptides in alum after initial injection with DNA (e.g., DNA+Protein) or protein (e.g., Protein+Protein). "Prot." represents "protein."

Figure 17:
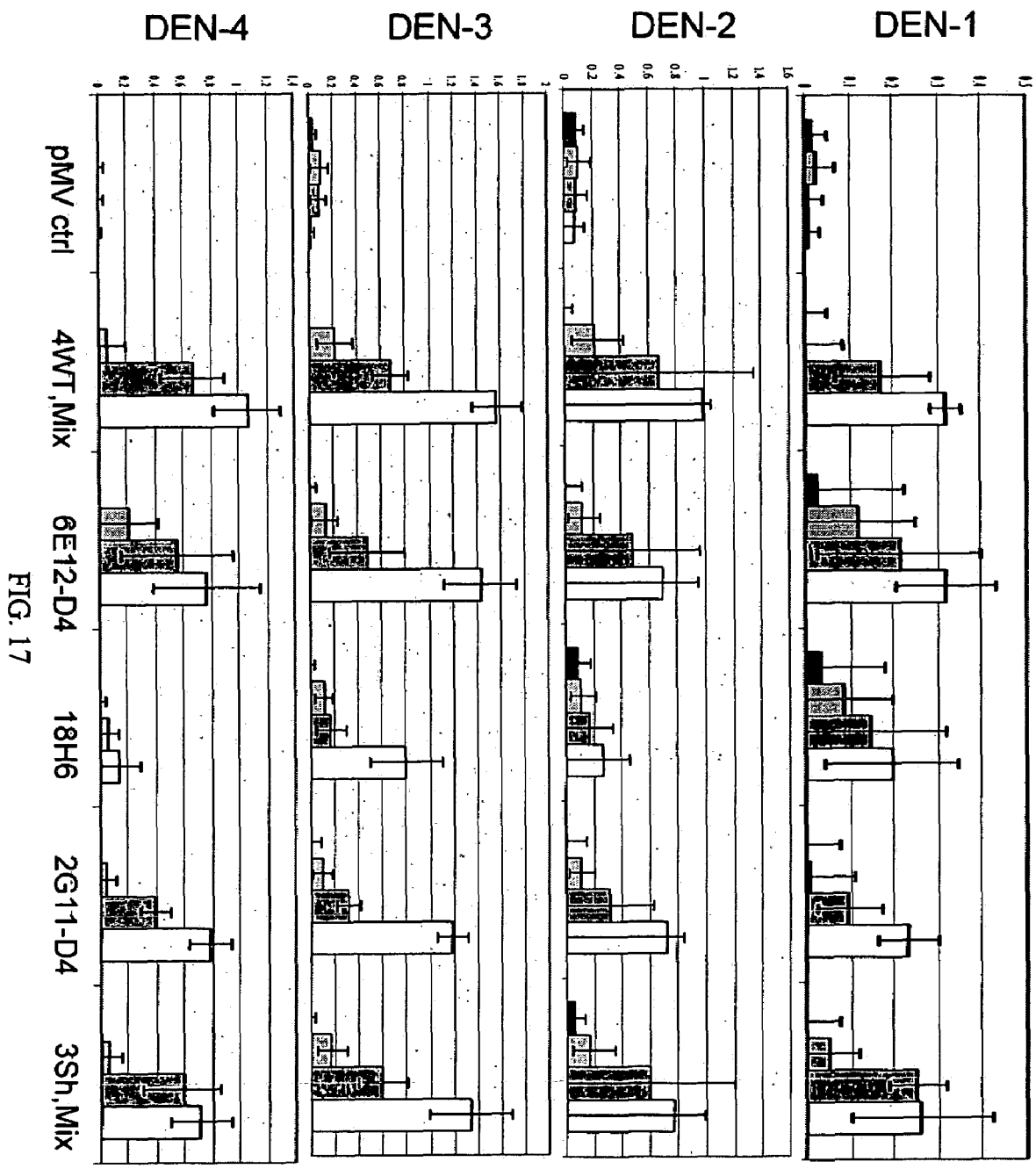

FIG. 17 presents a comparison of ELISA optical density values for antisera obtained at different time points (days 0, 28, 56, and 112) from blood of 6 monkeys per group, individually injected at days 0, 28, and 84 with: (1) a mixture comprising four pMaxVax10.1 nucleic acid vectors in PBS, each vector comprising one of four parental WT dengue virus C15/full length prM/full length E nucleic acids (4WT,Mix) encoding a WT DEN-1 DEN-2, DEN-3, or DEN-4 C15/full length prM/full length E polypeptide, respectively; (2) a pMaxVax10.1 vector comprising a representative recombinant PRM15/tE nuclei acid (18H6) that encodes a recombinant PRM15/tE dengue virus antigen; (3) a pMaxVax10.1 vector comprising a representative PRM C15/full length prM/full length E nucleic acid (6E12-D4 and 2G11-D4), each of which encodes a C15/full length prM/full length E dengue virus antigen; or (4) a mixture of three pMaxVax10.1 vectors in PBS, each vector comprising a nucleic acid corresponding to one of 18H6, 6E12-D4, and 2G11-D4 (3 Sh,Mix). The control ("pMV ctrl") is a pMaxVax10.1 vector that lacks a parental or recombinant PRM15/tE or C15/full length prM/full length E nucleic acid. All nucleic acid vectors were administered as compositions in PBS.

DETAILED DESCRIPTION OF THE INVENTION

The invention provides novel recombinant, synthetic, mutant, and/or isolated polypeptides, fusion proteins, antibodies, nucleic acids (e.g., polynucleotides), viruses, virus-like particles; vectors comprising such nucleic acids and/or encoding such polypeptides, fusion proteins, antibodies, viruses, and virus-like particles; cells and compositions comprising such nucleic acids, polypeptides, fusion proteins, antibodies, viruses, virus-like particles and/or vectors; and vaccines comprising one or more of the aforementioned nucleic acids, polypeptides, fusion proteins, antibodies, viruses, virus-like particles, vectors, cells, and compositions of the invention. The invention further provides methods of making and methods of using such nucleic acids, polypeptides, fusion proteins, antibodies, viruses, virus-like particles, vectors, cells, and compositions of the invention.

In one aspect, the nucleic acids, polypeptides, fusion proteins, vectors, viruses, virus-like particles, cells, antibodies and compositions are generally useful in modulating, promoting, inducing, and/or enhancing an immune response(s) to one or more flaviviruses and/or one or more dengue viruses of one or more serotypes, including, but not limited to, e.g., dengue-1, dengue-2, dengue-3, and dengue-4, or variants thereof, and/or analyzing biological samples for the presence of anti-flavivirus antibodies against at least one flavivirus of at least one flavivirus serotype or variant thereof, and more particularly anti-dengue virus antibodies against at least one of DEN-1 DEN-2, DEN-3, and DEN-4 viruses or a variant thereof. The nucleic acids, polypeptides, fusion proteins, vectors, viruses, virus-like particles, antibodies, cells, compositions, and methods of the invention described herein are also believed useful in in vivo methods for the prophylactic and/or therapeutic treatment of animals (including, e.g., vertebrates and mammals) of a disease(s) associated with at least one flavivirus of at least one serotype or a variant thereof (including, e.g., at least one dengue virus of at least one serotype or variant thereof), and in methods for the in vitro, ex vivo, and/or in vivo diagnosis, detection, and/or identification at least one flavivirus or variant thereof (including, e.g., at least one dengue virus of at least one serotype or variant thereof).

In one aspect, the nucleic acids, polypeptides, fusion proteins, vectors, viruses, virus-like particles, antibodies, cells, compositions, and methods of the invention are particularly useful in in vivo, and/or ex vivo methods of inducing or enhancing an immune response in an animal to at least one virus of the *Flaviviridae* family of viruses (e.g., a member of the *Flavivirus* genus such as Japanese encephalitis virus) and methods for the prophylactic and/or therapeutic treatment of animals (including, e.g., vertebrates and mammals) of a disease(s) associated with at least one virus that is a member of the *Flaviviridae* family of viruses, which includes flaviviruses, pestiviruses, and hepaciviruses, or variant of any such virus thereof, preferably wherein said at least one virus or variant thereof is a virus that is related to at least one dengue virus of at least one serotype (including, e.g., but not limited to, a virus of the *Flaviviridae* family, such as a member of the *Flavivirus* genus or another flavivirus, including, e.g., a yellow fever virus, St. Louis encephalitis virus, Japanese encephalitis virus, ticke-borne encephalitis virus, Murray Valley encephalitis virus, Russian spring-summer encephalitis virus, and/or West Nile virus, and including, e.g., those viruses that are described as being related to dengue viruses in FIELDS VIROLOGY, supra, Vol. 1, Chapters 32 and 33 ($4^{th}$ ed.), or any variant of any such virus).

In another aspect, the nucleic acids, polypeptides, fusion proteins, vectors, viruses, virus-like particles, antibodies, cells, compositions, and methods of the invention are useful in methods for the in vitro, ex vivo, and/or in vivo diagnosis, detection, and/or identification at least one virus of the *Flaviviridae* family (e.g., which consists of three genera, flavivirus, pestivirus, and hepacivirus) or a variant of any such virus thereof, preferably wherein said at least one virus or variant thereof is a virus that is related to at least one dengue virus (including, e.g., but not limited to, a virus of the *Flaviviridae* family, another flavivirus, yellow fever viruses, St. Louis encephalitis viruses, Japanese encephalitis viruses, ticke-borne encephalitis viruses, Murray Valley encephalitis virus, Russian spring-summer encephalitis virus, and/or West Nile viruses, and including, e.g., those viruses that are described as being related to dengue viruses in FIELDS VIROLOGY, supra, Vol. 1, Chapters 32 and 33 ($4^{th}$ ed.), or any variant of any such virus). As such, it will be understood that a reference to a dengue virus in the following detailed description can be construed as relating more generally to a virus of the *Flaviviridae* virus family, including a flavivirus, pestivirus, or hepacivirus, particularly to member of the *Flavivirus* genus, preferably to a flavivirus of at least one serotype, and especially to a flavivirus that is related or, preferably, closely related to at least one dengue virus of at least one serotype, unless otherwise stated or clearly contradicted by context. It will be understood that a reference to a polypeptide in the following detailed description can be construed, depending upon the context, as including a fusion protein.

The polypeptides, fusion proteins, nucleic acids, vectors, viruses, virus-like particles, compositions, cells, and methods of the invention are also useful in in vivo and/or ex vivo methods of inducing an immune response in animals and/or in in vivo and/or ex vivo methods of immunization of animals (including, e.g., vertebrates and mammals) against at least one virus of the *Flaviviridae* family, e.g., flavivirus, or variant thereof (including, e.g., a flavivirus that comprises or is related to at least one dengue virus of at least one dengue virus serotype or a variant thereof), and/or as a vaccine against at least one virus of the *Flaviviridae* family, e.g., flavivirus, or variant thereof, and/or more particularly as a vaccine against a virus of the *Flaviviridae* family, e.g., flavivirus, that comprises or is related to at least one dengue virus or variant thereof.

Advantageously, recombinant, synthetic, mutant, and/or isolated polypeptides and/or fusion proteins provided by the invention comprise an amino acid sequence that is capable of modulating, inducing, promoting, and/or enhancing a detectable immune response(s), such as the production of antibodies that bind to at least one virus of the *Flaviviridae* family, e.g., flavivirus (e.g., dengue virus), and/or the production of at least one type of antigen relating to the *Flaviviridae* family, e.g., flavivirus antigen (including, e.g., at least one type of dengue virus antigen) in animal cells (typically vertebrate cells, and more typically and preferably, mammalian cells, such as human and nonhuman primate cells) in vitro in cell culture and/or ex vivo and/or in vivo in a subject or tissue or cells obtained therefrom. Such an amino acid sequence portion of the polypeptide or fusion protein can be referred to as an "immunogenic amino acid" or "antigenic amino acid" or simply "the amino acid" or an "immunogen" or "antigen" of the invention.

A further desirable feature of the recombinant, synthetic, mutant, and/or isolated polypeptides of the invention, and the respective polynucleotides of the invention that encode such polypeptides, is the ability to induce, promote, modulate, and/or enhance an immune response(s) to at least one flavivirus, including, e.g., to at least one dengue virus of at least one serotype, and preferably to at least one dengue virus of each of at least two serotypes, more preferably to at least one dengue virus of each of at least three serotypes, and even more preferably to at least one dengue virus of each of at least four known virus dengue virus serotypes (e.g., DEN-1, DEN-2, DEN-3, and/or DEN-4).

A further desirable feature of the recombinant synthetic, mutant, and/or isolated polypeptides of the invention, and the polynucleotides that encode such polypeptides, is the ability to induce, promote, enhance or modulate a neutralizing antibody response(s) against at least one flavivirus, preferably against at least one dengue virus of at least one serotype, more preferably against at least one dengue virus of each of at least two serotypes, even more preferably against at least one dengue virus of each of at least three serotypes, and most preferably against at least one dengue virus of each of at least the four known virus dengue virus serotypes (e.g., DEN-1, DEN-2, DEN-3, and/or DEN-4).

More particular and desirable characteristics of the recombinant, synthetic, mutant, and/or isolated polypeptides and/or fusion proteins of the invention, polynucleotides encoding these and other polypeptides and fusion proteins, and related cells, antibodies, vectors, compositions, diagnostic assays and methods of making and using such polypeptides and polynucleotides are described in detail herein.

The term "PRM15" (or "prM15" and sometimes alternatively referred to as "spM") when used with reference to an amino acid generally refers to an amino acid sequence typically comprising about 15 amino acid residues. In some embodiments, the PRM15 amino acid sequence includes, in addition, a methionine ("Met" or "M") as the first amino acid residue; in such embodiments, the PRM15 sequence comprises a total of about 16 amino acids. Usually, a PRM15 amino acid sequence comprises the last 15 amino acid residues of the C terminus of a wild-type (WT), recombinant, mutant, or synthetic dengue virus prM protein, or variant thereof; in some such embodiments, the PRM15 amino acid sequence further comprises a methionine as the first amino acid residue of the sequence and thus is about 16 amino acids in length.

In reference to a nucleotide sequence, "PRM15" generally refers to a nucleotide sequence typically comprising about 15 amino acid residues. In some embodiments, the PRM15 nucleotide sequence includes three nucleotides residues that encode a methionine, which three residues are positioned as the first three residues of the sequence, followed in sequence order by the codons encoding the remaining approximately 15 amino acids. Usually, a PRM15 nucleotide sequence comprises nucleic acid residues that encode approximately the last 15 amino acids of the C terminus of a WT, recombinant, mutant, or synthetic dengue virus prM protein or variant thereof. In some such embodiments, the PRM15 nucleotide sequence further includes three residues that encode a methionine, which are positioned at the beginning of the nucleotide sequence; in such embodiments, the nucleotide sequence encodes a total of about 16 amino acids.

The PRM15 amino acid sequence is typically linked to a polypeptide and effectively acts as a signal sequence for transport of such polypeptide in a cell. The PRM15 signal sequence is usually cleaved from the polypeptide subsequently during processing. For example, in some embodiments, the PRM15 sequence is linked to a dengue virus envelope ("E" or "Env") protein, such as a WT, recombinant, mutant, or synthetic dengue virus E protein or to an antigenic or immunogen-encoding fragment (e.g., truncated recombinant, WT, or synthetic E protein) or variant thereof.

A variety of PRM15 amino acid signal sequences are described herein (see, e.g., SEQ ID NOS:52-64). A variety of PRM15 nucleotide sequences are also described herein (see, e.g., SEQ ID NOS:272-284). A PRM15 amino acid sequence can be readily determined from a prM protein sequence by identifying, e.g., approximately the last 15 amino acid residues of the C terminus of the prM sequence. If desired, a Met residue can be added at the beginning of the amino acid sequence. A PRM15 nucleic acid sequence can be similarly determined by identifying the nucleic acid residues that encode approximately the last 15 amino acid residues of the C terminus of a particular prM sequence; if desired, a nucleic acid codon encoding a Met residue can be similarly added as the first codon of such nucleic acid sequence. PRM15 amino acid and nucleic acid sequences can be synthesized by using standard protein and nucleic acid synthesis techniques, respectively, as would be know to one of skill in the art and as described below.

In one aspect, the invention includes a chimeric polypeptide comprising a sequence that has at least about 90% amino acid sequence identity to a polypeptide sequence comprising from amino acid residue 16 to the last amino acid residue of the amino acid sequence of a synthetic or recombinant C15/full prM/full E or PRM15/truncated E polypeptide of the invention, and nucleic acid encoding said chimeric polypeptide.

The term "tE" (or "ETRUNC" or "E-truncated" or the like) when used with reference to an amino acid sequence refers to a truncated ("t" or "trunc") envelope (E) protein of a flavivirus. Such flavivirus can be an isolated wild-type, recombinant, mutant, or synthetic flavivirus or variant thereof. In one aspect, the flavivirus comprises a dengue virus, and the truncated E protein comprises a truncated wild-type dengue virus E protein or a variant thereof, or a truncated recombinant, mutant, or synthetic dengue virus E protein. Compared to a non-truncated E protein, a truncated E protein lacks one or more amino acid residues of the C terminus of the non-truncated form of the E protein. When used with reference to a nucleic acid sequence, the term "tE" (or "ETRUNC" or "E-truncated" or the like) refers to a truncated nucleic acid sequence that corresponds to or encodes a truncated E protein. A nucleic acid sequence that encodes a truncated E protein similarly lacks one or more nucleic acid residues from the C terminus compared to the non-truncated nucleic acid.

In one embodiment, the truncated dengue envelope (E) protein (DEN-1, DEN-2, DEN-3, or DEN-4) comprises a polypeptide sequence comprising from about 70% to about 98% (e.g., about 85%, 86%, 87%, 88%, 90%, 92%, or 95%) of the contiguous amino acid residues of the respective dengue E protein as measured in sequence order from the N terminus amino acid residue of the amino acid sequence of the respective dengue E protein. In other words, the truncated E protein comprises a fragment of a dengue E protein sequence; such fragment lacks the amino acid residues corresponding to from about 2% to about 30% (e.g., about 15%, 14%, 13%, 12%, 10%, 8%, or 5%) of the amino acid residues of the respective full-length dengue E protein sequence, as measured from the C terminus amino acid residue of the full-length dengue E protein sequence. A nucleic acid sequence encoding such a truncated dengue E protein does not include the nucleotide residues encoding from about 2% to about 30% (e.g., about 15%, 14%, 13%, 12%, 10%, 8%, or 5%) of the amino acid residues of the C terminus of the respective full length dengue E protein sequence, as measured from the C terminus amino acid residue of the full length E protein sequence.

In one particular embodiment, the truncated DEN-1 E protein comprises a polypeptide sequence comprising from about 87% of the contiguous amino acid residues of the DEN-1 E protein as measured in sequence order from the N terminus amino acid residue, and the nucleic acid sequence encoding such a truncated DEN-1 E protein excludes nucleotide residues encoding about the last 13% of the amino acid residues of the C terminus of the DEN-1 E protein sequence, as measured from the C terminus amino acid residue.

In one particular embodiment, the truncated DEN-2 E protein comprises a polypeptide sequence comprising from about 90% of the contiguous amino acid residues of the DEN-2 E protein as measured in sequence order from the N terminus amino acid residue, and the nucleic acid sequence encoding such a truncated DEN-2 E protein excludes nucleotide residues encoding about the last 10% of the amino acid residues of the C terminus of the DEN-2 E protein sequence, as measured from the C terminus amino acid residue.

In one particular embodiment, the truncated DEN-3 E protein comprises a polypeptide sequence comprising from about 89% of the contiguous amino acid residues of the DEN-3 E protein as measured in sequence order from the N terminus amino acid residue, and the nucleic acid sequence encoding such a truncated DEN-3 E protein excludes nucleotide residues encoding about the last 11% of the amino acid residues of the C terminus of the DEN-3 E protein sequence, as measured from the C terminus amino acid residue.

In one embodiment, the truncated DEN-4 E protein comprises a polypeptide sequence comprising from about 90% of the contiguous amino acid residues of the DEN-4 E protein as measured in sequence order from the N terminus amino acid residue, and the nucleic acid sequence encoding such a truncated DEN-4 E protein excludes nucleotide residues encoding about the last 10% of the amino acid residues of the C terminus of the DEN-4 E protein sequence, as measured from the C terminus amino acid residue.

The term "CO" refers to "codon optimization" or a "codon optimized" sequence. When used with reference to a nucleic acid sequence, the term refers to a codon optimized nucleic acid sequence. When used with reference to an amino acid sequence, the term refers to an amino acid sequence that corresponds to or is encoded by a codon optimized nucleic acid sequence.

The terms "polypeptide," "protein," and "peptide," herein and used throughout synonymously refer to any polymer formed from multiple amino acids associated, at least in part, by covalent bonding (e.g., "protein" as used herein refers both to linear polymers (chains) of amino acids associated by peptide bonds as well as proteins exhibiting secondary, tertiary, or quaternary structure, which can include other forms of intramolecular and intermolecular association, such as hydrogen and van der Waals bonds, within or between peptide chain(s)), unless otherwise stated. The term "polypeptide" and "protein" includes fusion proteins, unless otherwise stated.

The term "recombinant" when used with reference to an amino acid (e.g., peptide, polypeptide, protein, antigen) typically refers to a non-naturally occurring amino acid (i.e., not found in nature) (e.g., non-naturally occurring peptide, polypeptide, protein, antigen). A "recombinant polypeptide" includes any polypeptide expressed or capable of being expressed from a recombinant nucleic acid (however, the recombinant nucleic acid sequence need not include all of the coding or nucleotide sequence elements necessary for expression), or any polypeptide comprising an amino acid sequence, wherein each amino acid residue of the sequence corresponds to or is capable of being encoded by a codon of a nucleic acid sequence, including a recombinant nucleic acid sequence.

The term "recombinant" when used with reference to a nucleic acid (e.g., a polynucleotide or other nucleotide) typically refers to a non-naturally occurring nucleic acid. When used with reference to a nucleic acid, the term "recombinant" may indicate that the nucleic acid has been modified by the introduction of at least one exogenous (i.e., foreign, and typically heterologous) nucleotide or the alteration of at least one native nucleotide component of the nucleic acid. A "recombinant vector" refers to a non-naturally occurring vector, including, e.g., a vector comprising a recombinant nucleic acid sequence.

In one aspect, a "recombinant polynucleotide" or a "recombinant polypeptide" is a non-naturally occurring polynucleotide or polypeptide. A recombinant polynucleotide or recombinant polypeptide may include nucleic acids or amino acids, respectively, from more than one source nucleic acid or polypeptide, which source nucleic acid or polypeptide can be a naturally occurring nucleic acid or polypeptide, or can itself have been subjected to mutagenesis, alteration, recombination, or other type of modification. The source polynucleotides or polypeptides from which the different nucleic acid or amino acid sequences are derived are sometimes homologous (i.e., have, or encode a polypeptide that encodes, the same or a similar structure and/or function), and are often from different isolates, serotypes, strains, species, of organism or from different disease states, for example.

The term "recombinant" when used with reference to a cell indicates that the cell comprises a recombinant molecule, such as a recombinant nucleic acid, recombinant polypeptide, or recombinant vector (e.g., non-naturally occurring nucleic acid, polypeptide, or vector). In one aspect, the term "recombinant" when used with reference to a cell indicates that the cell replicates a heterologous nucleic acid, or expresses a peptide or protein encoded by a heterologous nucleic acid. Recombinant cells can contain genes that are not found within the native (non-recombinant) form of the cell. Recombinant cells can also contain genes found in the native form of the cell wherein the genes are modified and re-introduced into the cell by artificial means. The term also encompasses cells that comprise a nucleic acid endogenous to the cell that has been modified without removing the nucleic acid from the cell; such modifications include, e.g., those obtained by gene replacement, site-specific mutation, and related techniques.

The term "synthetic" in reference to a molecule or component means an artificial or non-naturally occurring molecule or component, respectively. For example, a synthetic polynucleotide is an artificial, non-naturally occurring polynucleotide. Techniques for synthetically producing a molecule, component, or combination thereof, including, e.g., a synthetic polynucleotide, polypeptide, fusion protein, vector, virus, virus-like particle, cell, composition, and the like, are further described herein.

For ease of readability, recombinant, synthetic, mutant and/or variant polypeptides, polynucleotides, fusion proteins, vectors, cells, and antibodies of the invention are often referred to simply as "recombinant" polypeptides, polynucleotides, fusion proteins, vectors, cells, and antibodies, respectively.

The term "nucleic acid" refers to deoxyribonucleotides or ribonucleotides and polymers thereof in either single- or double-stranded form. Unless specifically limited, the term encompasses nucleic acids containing known analogues of natural nucleotides which have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences and as well as the sequence explicitly indicated. Specifically, degenerate codon substitutions may be achieved by generating sequences in which the third position of one or more selected (or all) codons is substituted with mixed-base and/or deoxyinosine residues (Batzer et al. (1991) *Nucleic Acid Res* 19:5081; Ohtsuka et al. (1985) *J Biol Chem* 260: 2605-2608; Cassol et al. (1992); Rossolini et al. (1994) *Mol Cell Probes* 8:91-98). The term nucleic acid is used interchangeably with polynucleotide, and (in appropriate contexts) gene, cDNA, and mRNA encoded by a gene.

"Nucleic acid derived from a gene" refers to a nucleic acid for whose synthesis the gene, or a subsequence thereof, has ultimately served as a template. Thus, an mRNA, a cDNA reverse transcribed from an mRNA, an RNA transcribed from that cDNA, a DNA amplified from the cDNA, an RNA transcribed from the amplified DNA, etc., are all derived from the gene and detection of such derived products is indicative of the presence and/or abundance of the original gene and/or gene transcript in a sample.

A nucleic acid is "operably linked" with another nucleic acid sequence when it is placed into a functional relationship with another nucleic acid sequence. For instance, a promoter or enhancer is operably linked to a coding sequence if it increases the transcription of the coding sequence. Operably linked means that the DNA sequences being linked are typically contiguous and, where necessary to join two protein coding regions, contiguous and in reading frame. However, since enhancers generally function when separated from the promoter by several kilobases and intronic sequences may be of variable lengths, some polynucleotide elements may be operably linked but not contiguous.

An "isolated" polypeptide refers to a polypeptide separated from one or more components and/or the environment with which it is normally associated (e.g., other peptides, polypeptides, proteins (including complexes, cellular contaminants, cellular components, etc.), cells, etc.). An "isolated" nucleic acid (or an isolated nucleotide or isolated polynucleotide) refers to a nucleic acid (or nucleotide or polynucleotide) that is isolated from one or more components and/or the environment with which it normally associates. Typically, an isolated nucleic acid refers to a nucleic acid that is not immediately contiguous with one or more nucleic acids with which it is immediately contiguous (i.e., at the 5' and/or 3' end) in the sequence from which it is obtained and/or derived.

Typically, isolation of a component (e.g., polypeptide, polynucleotide, fusion protein, vector, cell) renders it the predominant component present in a composition, mixture, or collection of components; i.e., on a molar basis it is more abundant than any other individual species in the composition. For example, isolation of a polypeptide or polynucleotide renders the polypeptide or polynucleotide, respectively, the predominant molecule or species present in a composition, mixture, or collection of molecules. Such a "substantially pure" polypeptide or polynucleotide (or other component), for example, typically forms at least about 50%, at least about 60%, at least about 70%, at least about 80%, at least about 90%, at least about 95%, by weight (typically on a molar basis), of all macromolecular species present in a particular composition. Desirably, the substantially pure polypeptide or polynucleotide exhibits essential homogeneity (i.e., contaminant species cannot be detected in the composition by conventional detection methods). The term "purified" generally denotes that a polynucleotide or polypeptide is free or at least substantially free of other components as determined by standard analytical techniques (e.g., forms a band electrophoretic gel, chromatographic eluate, and/or a media subjected to density gradient centrifugation) and/or forms at least about 80%, at least about 85%, preferably at least about 90%, and more preferably at least about 95%, of the macromolecular species in a particular composition.

The term "subject" as used herein includes, but is not limited to, an organism; an animal, including a mammal, which includes, e.g., a human, non-human primate (e.g., baboon, orangutan, chimpanzee, monkey), mouse, pig, cow, goat, cat, rabbit, rat, guinea pig, hamster, horse, monkey, sheep, or other non-human mammal, and a non-mammal, including, e.g., a non-mammalian vertebrate, such as a bird (e.g., a chicken or duck) or a fish, and a non-mammalian invertebrate.

The term "cytokine" includes, for example, interleukins, interferons, chemokines, hematopoietic growth factors, tumor necrosis factors and transforming growth factors. In general these are small molecular weight proteins that regulate maturation, activation, proliferation, and differentiation of cells of the immune system.

A "variant" of a polypeptide is a polypeptide that differs in one or more amino acid residues from a parent or reference polypeptide, usually in at least about 1, 2, 3, 4, 5, 6, 7, 8, 9, 10, 11, 12, 13, 14, 15, 20, 25, 50, 75, 100 or more amino acid residues.

A "variant" of a nucleic acid is a nucleic acid that differs in one or more nucleic acid residues from a parent or reference nucleic acid, usually in at least about 1, 2, 3, 4, 5, 6, 7, 8, 9, 10, 11, 12, 13, 14, 15, 17, 20, 21, 24, 27, 30, 33, 36, 39, 40, 45, 50, 60, 75, 150, 225, 300 or more nucleic acid residues.

An "antigen" refers to a molecule that is capable of inducing, promoting, enhancing, or modulating an immune response or immune reaction. In some instances, the immune response or immune reaction is a humoral and/or cellular response. An antigen may induce, promote, enhance or modulate an immune response or immune reaction in cells in vitro and/or in vivo in a subject and/or ex vivo in a subject's cells or tissues. Such immune response or reaction may include, but is not limited to, eliciting the formation of antibodies in a subject, or generating a specific population of lymphocytes reactive with the antigen. Antigens are typically macromolecules (e.g., proteins and polysaccharides) that are foreign to the host.

A "subsequence" or "fragment" of nucleic acids or amino acids refers to a sequence of nucleic acids or amino acids, respectively, that comprises any part or segment of a longer sequence of nucleic acids (e.g., polynucleotide) or amino acids (e.g., polypeptide), respectively, up to and including the complete (entire) nucleic acid sequence or complete amino acid sequence.

An "adjuvant" refers to a molecule or substance that augments or enhances an immune response, including, for example, but not limited to, an antigen's immune-stimulating properties or the pharmacological effect(s) of a compound or drug. An adjuvant may non-specifically enhance an immune response, e.g., the immune response to an antigen. "Freund's Complete Adjuvant," for example, is an emulsion of oil and water containing an immunogen, an emulsifying agent and mycobacteria. Another example, "Freund's incomplete adjuvant," is the same, but without mycobacteria. An adjuvant may comprise oils, emulsifiers, killed bacteria, aluminum hydroxide, or calcium phosphate (e.g., in gel form), or combinations thereof. An adjuvant may be administered into a subject (e.g., via injection intramuscularly or subcutaneously) in an amount sufficient to produce antibodies.

"Naturally occurring" as applied to an object refers to the fact that the object can be found in nature as distinct from being artificially produced by man. A polypeptide or polynucleotide sequence that is present in an organism (including viruses, bacteria, protozoa, insects, plants or mammalian tissue) that can be isolated from a source in nature and which has not been intentionally modified by man in the laboratory is naturally occurring. Non-naturally occurring as applied to an object means that the object is not naturally-occurring—i.e., the object cannot be found in nature as distinct from being artificially produced by man.

Numbering of a given amino acid polymer or nucleotide polymer "corresponds to numbering" of a selected amino acid polymer or nucleic acid polymer when the position of any given polymer component (e.g., amino acid residue, nucleotide residue) is designated by reference to the same or an equivalent residue position in the selected amino acid or nucleotide polymer, rather than by the actual position of the component in the given polymer. Thus, for example, the numbering of a given amino acid position in a given polypeptide sequence corresponds to the same or equivalent amino acid position in a selected polypeptide sequence used as a reference sequence.

A vector is a component or composition for facilitating cell transduction or transfection by a nucleic acid, or expression of the nucleic acid in the cell. Vectors include, e.g., plasmids, cosmids, viruses, YACs, bacteria, poly-lysine, etc. An "expression vector" or "expression cassette" is a nucleic acid construct or sequence with nucleic acid elements that permit transcription of a nucleic acid in a host cell and/or that are capable of effecting expression of a nucleic acid in a host compatible with such construct or sequence. An expression vector or cassette can be generated recombinantly or synthetically by methods known in the art. The expression vector or cassette can be part of a plasmid, virus, or nucleic acid fragment. The expression vector or expression cassette typically includes a nucleic acid to be transcribed (e.g., a nucleic acid encoding a desired polypeptide) operably linked to a promoter. The nucleic acid to be transcribed is typically under the direction or control of the promoter. An expression vector or cassette optionally includes transcription termination signal(s). Additional factors necessary or helpful in effecting expression may also be used as described herein. For example, an expression vector or cassette can also include nucleotide sequences that encode a signal sequence that directs secretion of an expressed protein from the host cell. Enhancers and other nucleic acid sequences that influence nucleotide expression or gene expression can also be included.

"Substantially the entire length of a polynucleotide sequence" or "substantially the entire length of a polypeptide sequence" refers to at least about 50%, generally at least about 60%, 70%, or 75%, usually at least about 80% or 85%, or typically at least about 90%, 91%, 92%, 93%, 94%, 95%, 96%, 97%, 98%, 99%, 99.5% or more of a length of a polynucleotide sequence or polypeptide sequence.

The term "pharmaceutical composition" means a composition suitable for pharmaceutical use in a subject, including an animal or human. A pharmaceutical composition generally comprises an effective amount of an active agent and a carrier, including, e.g., a pharmaceutically acceptable carrier.

The term "effective amount" means a dosage or amount of a molecule or composition sufficient to produce a desired result. For example, the desired result may comprise a measurable or testable induction, promotion, enhancement or modulation of an immune response in a subject to whom a dosage or amount of a particular antigen or immunogen (or composition thereof) has been administered. In one aspect, the desired result may comprise a measurable or testable induction, promotion, enhancement of an immune response in a subject to whom a dosage or amount of a particular viral antigen or immunogen (or composition thereof) has been administered sufficient to protect the subject against challenge by a virus. In another aspect, the desired result may comprise an objective or subjective improvement in the subject receiving a dosage or amount of a particular molecule or composition (e.g., the subject to whom the dosage or amount of the particular molecule or composition is administered).

A "prophylactic treatment" is a treatment administered to a subject who does not display and/or suffer from signs or symptoms of a disease, pathology, or medical disorder, or displays and/or suffers from only early signs or symptoms of a disease, pathology, or disorder, such that treatment is administered for the purpose of diminishing, preventing, and/or decreasing the risk of developing the disease, pathology, or medical disorder. A prophylactic treatment functions as a preventative treatment against a disease or disorder. A "prophylactic activity" is an activity of an agent, such as a nucleic acid, vector, gene, polypeptide, protein, molecule, substance, or composition thereof, that when administered to a subject who does not display and/or suffer from signs or symptoms of pathology, disease, or disorder, or who displays and/or suffers from only early signs or symptoms of pathology, disease, or disorder, can diminish, prevent, and/or decrease the risk of the subject developing such pathology, disease, or disorder. A "prophylactically useful" agent or molecule (e.g., nucleic acid or polypeptide) refers to an agent or molecule useful in diminishing, preventing, immunizing against, treating, and/or decreasing development of a pathology, disease, or disorder.

A "therapeutic treatment" is a treatment administered to a subject who displays and/or suffers from symptoms or signs of pathology, disease, or disorder, for the purpose of diminishing, treating, and/or eliminating those signs or symptoms of pathology, disease, or disorder. A "therapeutic activity" is an activity of an agent, such as a nucleic acid, vector, gene, polypeptide, protein, molecule, substance, or composition thereof, that eliminates, treats, and/or diminishes signs or symptoms of pathology, disease, or disorder, when administered to a subject displaying and/or suffering from such signs or symptoms. A "therapeutically useful" agent or molecule (e.g., nucleic acid or polypeptide) is an agent or molecule that is useful in diminishing, treating, and/or eliminating such signs or symptoms of a pathology, disease, or disorder.

The term "gene" broadly refers to any segment of DNA associated with a biological function. Genes include coding sequences and/or regulatory sequences required for their expression. Genes also include non-expressed DNA nucleic acid segments that, e.g., form recognition sequences for other proteins (e.g., promoter, enhancer, or other regulatory regions). Genes can be obtained from a variety of sources, including cloning from a source of interest or synthesizing from known or predicted sequence information, and may include sequences designed to have desired parameters.

Generally, the nomenclature used hereafter and the laboratory procedures in cell culture, molecular genetics, molecular biology, nucleic acid chemistry, and protein chemistry described below are those well known and commonly employed by those of ordinary skill in the art. Standard techniques, such as described in Sambrook et al., *Molecular Cloning—A Laboratory Manual* (2nd Ed.), Vols. 1-3, Cold Spring Harbor Laboratory, Cold Spring Harbor, N.Y., 1989 (hereinafter "Sambrook") and *Current Protocols in Molecular Biology*, F. M. Ausubel et al., eds., Current Protocols, a joint venture between Greene Publishing Associates, Inc. and John Wiley & Sons, Inc. (1994, supplemented through 1999) (hereinafter "Ausubel"), are used for recombinant nucleic acid methods, nucleic acid synthesis, cell culture methods, and transgene incorporation, e.g., electroporation, injection, gene gun, impressing onto or through the skin or tissue of a subject, and lipofection. Generally, oligonucleotide synthesis and purification steps are performed according to specifications. The techniques and procedures are generally performed according to conventional methods in the art and various general references which are provided throughout this document. The procedures therein are believed to be well known to those of ordinary skill in the art and are provided for the convenience of the reader.

As used herein, an "antibody" refers to a protein comprising one or more polypeptides substantially or partially encoded by immunoglobulin genes or fragments of immunoglobulin genes. The term antibody is used to mean whole antibodies and binding fragments thereof. The recognized immunoglobulin genes include the kappa, lambda, alpha, gamma, delta, epsilon and mu constant region genes, as well as myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively. A typical immunoglobulin (e.g., antibody) structural unit comprises a tetramer. Each tetramer is composed of two identical pairs of polypeptide chains, each pair having one "light" (about 25 KDa) and one "heavy" chain (about 50-70 KDa). The N-terminus of each chain defines a variable region of about 100 to 110 or more amino acids primarily responsible for antigen recognition. The terms variable light chain (VL) and variable heavy chain (VH) refer to these light and heavy chains, respectively.

Antibodies exist as intact immunoglobulins or as a number of well characterized fragments produced by digestion with various peptidases. Thus, for example, pepsin digests an antibody below the disulfide linkages in the hinge region to produce F(ab)'2, a dimer of Fab which itself is a light chain joined to VH-CH1 by a disulfide bond. The F(ab)'2 may be reduced under mild conditions to break the disulfide linkage in the hinge region thereby converting the (Fab')2 dimer into an Fab' monomer. The Fab' monomer is essentially an Fab with part of the hinge region. The Fc portion of the antibody molecule corresponds largely to the constant region of the immunoglobulin heavy chain, and is responsible for the antibody's effector function (see, *Fundamental Immunology*, W. E. Paul, ed., Raven Press, N.Y. (1993), for a more detailed description of other antibody fragments). While various antibody fragments are defined in terms of the digestion of an intact antibody, one of skill will appreciate that such Fab' fragments may be synthesized de novo either chemically or by utilizing recombinant DNA methodology. Thus, the term antibody, as used herein also includes antibody fragments either produced by the modification of whole antibodies or synthesized de novo using recombinant DNA methodologies.

Antibodies also include single-armed composite monoclonal antibodies, single chain antibodies, including single chain Fv (sFv) antibodies in which a variable heavy and a variable light chain are joined together (directly or through a peptide linker) to form a continuous polypeptide, as well as diabodies, tribodies, and tetrabodies (Pack et al. (1995) *J Mol Biol* 246:28; *Biotechnol* 11:1271; and *Biochemistry* 31:1579). The antibodies are, e.g., polyclonal, monoclonal, chimeric, humanized, single chain, Fab fragments, fragments produced by an Fab expression library, or the like.

The term "epitope" generally refers to a peptide or polypeptide determinant capable of specifically binding to an antibody. Epitopes usually consist of chemically active surface groupings of molecules such as amino acids or sugar side chains and usually have specific three-dimensional structural characteristics, as well as specific charge characteristics. Conformational and nonconformational epitopes are distinguished in that the binding to the former but not the latter is lost in the presence of denaturing solvents.

An "antigen-binding fragment" of an antibody is a peptide or polypeptide fragment of the antibody that binds or selectively binds an antigen. An antigen-binding site is formed by those amino acids of the antibody that contribute to, are involved in, or affect the binding of the antigen. See Scott, T. A. and Mercer, E. I., *Concise Encyclopedia: Biochemistry and Molecular Biology* (de Gruyter, 3d ed. 1997), and Watson, J. D. et al., *Recombinant DNA* (2d ed. 1992) [hereinafter "Watson, Recombinant DNA"], each of which is incorporated herein by reference in its entirety for all purposes.

The term "screening" describes, in general, a process that identifies optimal or optimized molecules. Several properties of the respective molecules can be used in selection and screening including, for example, ability to induce a desired immune response in a test system. Selection is a form of screening in which identification and physical separation are achieved simultaneously by expression of a selection marker, which, in some genetic circumstances, allows cells expressing the marker to survive while other cells die (or vice versa). Because of limitations in studying primary immune responses in vitro, in vivo studies are particularly useful screening methods. In one aspect, screening refers to a process that identifies a polypeptide (or a nucleic acid encoding such polypeptide), wherein the polypeptide induces or is capable of inducing an immune response to at least a portion of dengue viruses of at least one virus serotype in a subject, or cells of a subject, that is about equal to or greater than the immune response induced or capable of being induced by a reference polypeptide (e.g., wild-type polypeptide).

A "specific binding affinity" between two molecules, e.g., a ligand and a receptor, means a preferential binding of one molecule for another in a mixture of molecules. The binding of the molecules is typically considered specific if the binding affinity is about $1 \times 10^2$ $M^{-1}$ to about $1 \times 10^{10}$ $M^{-1}$ (i.e., about $10^{-2}$-$10^{-10}$ M) or greater, including about $10^4$ to $10^6$ M$^{-1}$, about $10^6$ to $10^7$ M$^{-1}$, or about $10^8$ M$^{-1}$ to $10^9$ M$^{-1}$ or $10^{10}$ M$^{-1}$.

"Avidity" refers to the tendency of an antibody to bind an antigen. The higher the avidity, the greater the affinity of the antibody for the antigen, the greater the binding of the antibody to the antigen, and the greater the stability of the antigen-antibody complex formed by binding of the antibody to the antigen.

The term "immunoassay" includes an assay that uses an antibody or immunogen to bind or specifically bind an antigen. The immunoassay may be characterized by the use of specific binding properties of a particular antibody to isolate, target, and/or quantify the antigen.

The invention provides a recombinant, synthetic, mutant, and/or isolated polypeptide comprising an immunogenic amino acid sequence that is substantially identical (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) to an amino acid sequence of at least one of SEQ ID NOS:1-49, 65-116, 139-148, 153-155, 236-253, 343, and 345. In addition, the invention provides a recombinant, synthetic, mutant, and/or isolated polynucleotide that encodes an immunogenic amino acid sequence that is substantially identical to a nucleic acid sequence of at least one of SEQ ID NOS:156-218, 235, 254-271, 285-330, 342, and 344. As applied to polypeptides, the term "substantial identity" means that two or more amino acid sequences, when optimally aligned, such as by GAP or BESTFIT programs using default gap weights, by visual inspection, or any other suitable technique such as the sequence analysis and identity algorithms further describe herein, share at least about 60%, typically at least about 65%, usually at least about 70%, often at least about 75%, usually at least about 80%, at least about 85%, about 86%, about 87%, about 88%, or about 89%, and preferably at least about 90%, or more (e.g., at least about 91%, about 92%, about 93%, about 94%, about 95%, about 96%, about 97%, about 97.5%, about 98%, about 98.5%, about 99%, or about 99.5% or more) amino acid sequence identity. Similarly, as applied to nucleic acids, the term substantial identity or substantial similarity means that the two or more nucleic acid sequences, when optimally aligned, such as by the programs BLAST, GAP or BESTFIT using default gap weights (described in detail below along with other suitable programs and techniques for assessing nucleic acid sequence identity levels), or by visual inspection, share at least about 60% nucleic acid sequence identity or sequence similarity, at least about 70% or at least about 75% sequence identity or sequence similarity, more desirably at least about 80 or about 85% nucleic acid sequence identity or sequence similarity; preferably at least about 90% nucleic acid sequence identity or sequence similarity, and more preferably at least about 95% nucleic acid sequence identity or sequence similarity (including, e.g., about 90, 91, 92, 93, 94, 95, 96, 97, 98, 98.5, 99, 99.5, or more percent nucleotide sequence identity or sequence similarity).

"Identity" (sometimes referred to as "overall identity"—in contrast to "local identity," which is discussed further herein) with respect to amino acid or nucleotide sequences refers to the percentage of amino acid residues or nucleotide bases, respectively, that are identical in the two amino acid or nucleotide sequences when two such amino acid sequences or two such nucleotide sequences are optimally aligned with one another. If, in the optimal alignment, a position in a first sequence is occupied by the same amino acid residue or nucleotide residue as the corresponding position in the second corresponding amino acid or nucleotide sequence, the sequences exhibit identity with respect to that residue position. The level of identity between two sequences (or "percent sequence identity") is measured as a ratio of the number of identical positions shared by the sequences with respect to the size of the sequences analyzed (i.e., percent sequence identity=(number of identical positions/total number of positions)×100).

The "optimal alignment" is the alignment that provides the highest identity between the aligned sequences. In obtaining the optimal alignment, gaps can be introduced, and some amount of non-identical sequences and/or ambiguous sequences can be ignored. Preferably, if a gap needs to be inserted into a first sequence to achieve the optimal alignment, the percent identity is calculated using only the residues that are paired with a corresponding amino acid residue (i.e., the calculation does not consider residues in the second sequences that are in the "gap" of the first sequence). However, it is often preferable that the introduction of gaps and/or the ignoring of non-homologous/ambiguous sequences are associated with a "gap penalty."

While identity between relatively short amino acid or nucleic acid sequences can be easily determined by visual inspection, analysis with an appropriate algorithm, typically facilitated through computer software, commonly is used to determine identity between longer sequences. When using a sequence comparison algorithm, test and reference sequences typically are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters. A number of mathematical algorithms for rapidly obtaining the optimal alignment and calculating identity between two or more sequences are known and incorporated into a number of available software programs. Examples of such programs include the MATCH-BOX, MULTAIN, GCG, FASTA, and ROBUST programs for amino acid sequence analysis, and the SIM, GAP, NAP, LAP2, GAP2, and PIPMAKER programs for nucleotide sequences. Preferred software analysis programs for both amino acid and polynucleotide sequence analysis include the ALIGN, CLUSTALW (e.g., version 1.6 and later versions thereof), and BLAST programs (e.g., BLAST 2.1, BL2SEQ, and later versions thereof). Select examples of which are further described in the following paragraphs.

For amino, acid sequence analysis, a weight matrix, such as the BLOSUM matrixes (e.g., the BLOSUM45, BLOSUM50, BLOSUM62, and BLOSUM80 matrixes—as described in, e.g., Henikoff and Henikoff (1992) *Proc Natl Acad Sci USA* 89:10915-10919), Gonnet matrixes (e.g., the Gonnet40, Gonnet80, Gonnet120, Gonnet160, Gonnet250, and Gonnet350 matrixes), or PAM matrixes (e.g., the PAM30, PAM70, PAM120, PAM160, PAM250, and PAM350 matrixes), are used in determining identity. BLOSUM matrixes are preferred. The BLOSUM50 and BLOSUM62 matrixes are typically most preferred. In the absence of availability of such weight matrixes (e.g., in nucleic acid sequence analysis and with some amino acid analysis programs), a scoring pattern for residue/nucleotide matches and mismatches can be used (e.g., a +5 for a match and −4 for a mismatch pattern).

The ALIGN program produces an optimal global (overall) alignment of the two chosen protein or nucleic acid sequences using a modification of the dynamic programming algorithm described by Myers and Miller (1988) *CABIOS* 4:11-17. Preferably, if available, the ALIGN program is used with weighted end-gaps. If gap opening and gap extension penalties are available, they are preferably set between about −5 to −15 and 0 to −3, respectively, more preferably about −12 and −0.5 to −2, respectively, for amino acid sequence alignments, and −10 to −20 and −3 to −5, respectively, more preferably about −16 and −4, respectively, for nucleic acid sequence alignments. The ALIGN program and principles underlying it are further described in, e.g., Pearson et al. (1988) *Proc Natl Acad Sci USA* 85:2444-48, and Pearson et al. (1990) *Methods Enzymol* 18:63-98.

Alternatively, and particularly for multiple sequence analysis (i.e., comparison of more than three sequences), the CLUSTALW program (described in, e.g., Thompson, J. D. et al. (1994) *Nuc Acids Res* 22:4673-4680) can be used. In one aspect, Gap open and Gap extension penalties are set at 10 and 0.05, respectively. Alternatively or additionally, the CLUSTALW program is run using "dynamic" (versus "fast") settings. Preferably, nucleotide sequence analysis with CLUSTALW is performed using the BESTFIT matrix, whereas amino acid sequences are evaluated using a variable set of BLOSUM matrixes depending on the level of identity between the sequences (e.g., as used by the CLUSTALW version 1.6 program available through the San Diego Supercomputer Center (SDSC)). Preferably, the CLUSTALW settings are set to the SDSC CLUSTALW default settings (e.g., with respect to special hydrophilic gap penalties in amino acid sequence analysis). The CLUSTALW program and underlying principles of operation are further described in, e.g., Higgins et al. *CABIOS*, (1992) 8(2): 189-91, Thompson et al. (1994) *Nucleic Acids Res* 22:4673-80, and Jeanmougin et al. (1998) *Trends Biochem Sci* 2:403-07.

Another useful algorithm for determining percent identity is the FASTA algorithm, which is described in Pearson, W.R. & Lipman, D. J. (1988) *Proc Natl Acad Sci USA* 85:2444. See also, W. R. Pearson (1996) *Methods Enzymol* 266:227-258. Preferred parameters used in a FASTA alignment of DNA sequences to calculate percent identity are optimized, BL50 Matrix 15: −5, k-tuple=2; joining penalty=40, optimization=28; gap penalty −12, gap length penalty=−2; and width=16.

Other preferred algorithms include the BLAST and BLAST 2.0 algorithms, which facilitate analysis of at least two amino acid or nucleotide sequences, by aligning a selected sequence against multiple sequences in a database (e.g., GenSeq), or, when modified by an additional algorithm such as BL2SEQ, between two selected sequences. Software for performing BLAST analyses is publicly available through the National Center for Biotechnology Information (NCBI) (http://www.ncbi.nlm.nih.gov/). The BLAST algorithm parameters W, T, and X determine the sensitivity and speed of the alignment. The BLASTN program (for nucleotide sequences) can be used with a word length (W) of 11, an expectation (E) of 10, M=5, N=−4 and a comparison of both strands. For amino acid sequences, the BLASTP program (e.g., BLASTP 2.0.14; Jun. 29, 2000) can be used with a word length of 3 and an expectation (E) of 10.

BLAST program analysis also or alternatively is preferably modified by low complexity filtering programs such as the DUST or SEG programs, which are preferably integrated into the BLAST program operations (see, e.g., Wootton et al. (1993) *Comput Chem* 17:149-63, Altschul et al. (1991) *Nat Genet* 6:119-29, Hancock et al. (1991) *Comput Appl Biosci* 10:67-70, and Wootton et al. (1996) *Meth Enzymol* 266:554-71). In such aspects, if a lambda ratio is used, preferred settings for the ratio are between 0.75 and 0.95, more preferably between 0.8 and 0.9. If gap existence costs (or gap scores) are used in such aspects, the gap existence cost preferably is set between about −5 and −15, more preferably about −10, and the per residue gap cost preferably is set between about 0 to −5, more preferably between 0 and −3 (e.g., −0.5). Similar gap parameters can be used with other programs as appropriate. The BLAST programs and principles underlying them are further described in, e.g., Altschul et al. (1990) *J Mol Biol* 215:403-10, Karlin and Altschul (1990) *Proc Natl Acad Sci USA* 87:2264-68 (as modified by Karlin and Altschul (1993) *Proc Natl Acad Sci USA* 90:5873-77), and Altschul et al. (1997) *Nucl Acids Res* 25:3389-3402.

Another example of a useful algorithm is incorporated in PILEUP software. The PILEUP program creates a multiple sequence alignment from a group of related sequences using progressive, pair-wise alignments to show relationship and percent sequence identity or percent sequence similarity. PILEUP uses a simplification of the progressive alignment method of Feng & Doolittle (1987) *J Mol Evol* 35:351-360, which is similar to the method described by Higgins & Sharp (1989) *CABIOS* 5:151-153. Preferred parameters for the PILEUP program are: default gap weight (3.00), default gap length weight (0.10), and weighted end gaps. PILEUP is a component of the GCG sequence analysis software package, e.g., version 7.0 (see, e.g., Devereaux et al. (1984) *Nuc Acids Res* 12:387-395).

Other useful algorithms for performing identity analysis include the local homology algorithm of Smith and Waterman (1981) *Adv Appl Math* 2:482, the homology alignment algorithm of Needleman and Wunsch (1970) *J Mol Biol* 48:443, and the search for similarity method of Pearson and Lipman (1988) *Proc Natl Acad Sci USA* 85:2444. Computerized implementations of these algorithms (e.g., GAP, BESTFIT, and TFASTA) are provided in the Wisconsin Genetics Software Package Release 7.0, Genetics Computer Group, 575 Science Dr., Madison, Wis.

Several additional commercially available software suites incorporate the ALIGN, BLAST, and CLUSTALW programs and similar functions, and may include significant improvements in settings and analysis. Examples of such programs include GCG suite of programs and those available through DNASTAR, Inc. (Madison, Wis.), such as Lasergene® and Protean® programs. A preferred alignment method is the Jotun Hein method, incorporated within the MegaLine™ DNASTAR package (MegaLine™ Version 4.03) used according to the manufacturer's instructions and default values specified in the program.

Because various algorithms, matrixes, and programs are commonly used to analyze sequences, amino acid and polynucleotide sequences are preferably characterized in terms of approximate identities by indicating a range of identity "about" a particular identity (e.g.; +/−10%, more preferably +/−8%, and even more preferably +/−5% of the particular identity). Nonetheless, an exact identity can be measured by using only one of the aforementioned programs, such as a BLAST program described herein or the Hein method.

In one aspect, the invention provides a recombinant, synthetic, and/or isolated polypeptide (which may be simply referred to as the polypeptide or recombinant polypeptide) which comprises an amino acid sequence that has at least about 90% amino acid sequence identity to an amino acid sequence of at least one of SEQ ID NOS:1-49, 65-116, 139-148, 153-155, 236-253, 343, and 345. Desirably, the recombinant polypeptide comprises a sequence that has at least about 90% amino acid sequence identity to at least two sequences selected from the group of SEQ ID NOS:1-49, 65-116, 139-148, 153-155, 236-253, 343, and 345. Favorably, the recombinant polypeptide comprises a sequence that has at least about 90% amino acid sequence identity to at least five sequences selected from the group of SEQ ID NOS:1-49, 65-116, 139-148, 153-155, 236-253, 343, and 345. Advantageously, the recombinant polypeptide comprises a sequence that has at least about 90% amino acid sequence identity to at least about ten, preferably at least about fifteen, and more preferably at least about twenty sequences selected from the group of SEQ ID NOS:1-49, 65-116, 139-148, 153-155, 236-253, 343, and 345. Preferably, the recombinant polypeptide comprises an amino acid sequence that has at least about 75%, at least about 80%, at least about 85%, at least about 90%, at least about 95%, at least about 96%, at least about 97%, at least about 98%, or at least about 99% identity to at least one, preferably at least five, and more preferably at least about ten sequences selected from any of SEQ ID NOS:1-49, 65-116, 139-148, 153-155, 236-253, 343, and 345.

A recombinant polypeptide that comprises an amino acid selected from the group of SEQ ID NOS:1-49, 65-116, 139-148, 153-155, 236-253, 343, and 345 is preferred. The polypeptide can comprise any number of suitable additional amino acid sequences, such as, e.g., additional sequences described elsewhere herein (e.g., signal sequence and/or purification-facilitating epitope tag (e.g., Whitehorn et al., *Biotechnology* 13:1215-19 (1995)), or the polypeptide can consist essentially entirely of an amino acid sequence selected from the group of SEQ ID NOS:1-49, 65-116, 139-148, 153-155, 236-253, 343, and 345.

Alternatively, but more typically additionally, the recombinant polypeptide can comprise an amino acid sequence that has substantial functional homology to the immunogenic amino acid sequence of any polypeptide of the invention, such as the amino acid sequence of any one of SEQ ID NOS:1-49, 65-116, 139-148, 153-155, 236-253, 343, and 345. "Substantial functional homology" means that the analyzed amino acid sequences share at least about 60%, typically at least about 65%, usually at least about 70%, often at least about 75%, preferably at least about 80%, more preferably at least about 85%, and even more preferably at least about 90%, or more (e.g., 91%, 92%, 93%, 94%, 95%, 96%, 97%, 98%, 99%, or 99.5% or more) functionally homologous residues in the optimal homology alignment. The "optimal functional homology alignment" is the alignment that provides the highest level of homology between two amino acid sequences, using the principles described above with respect to the "optimal alignment." Conservative amino acid residue substitutions involve exchanging a member within one class of amino acid residues for a residue that belongs to the same class (identical amino acid residues are considered functionally homologous or conserved in calculating percent functional homology). The classes of amino acids and the members of those classes are presented in Table 1.

TABLE 1

Amino Acid Residue Classes

| Amino Acid Class | Amino Acid Residues |
|---|---|
| Acidic Residues | ASP and GLU |
| Basic Residues | LYS, ARG, and HIS |
| Hydrophilic Uncharged Residues | SER, THR, ASN, and GLN |
| Aliphatic Uncharged Residues | GLY, ALA, VAL, LEU, and ILE |
| Non-polar Uncharged Residues | CYS, MET, and PRO |
| Aromatic Residues | PHE, TYR, and TRP |

An alternative set of conservative amino acid substitutions, delineated by six conservation groups, is provided in Table 2.

TABLE 2

Alternative Amino Acid Residue Substitution Groups

| 1 | Alanine (A) | Serine (S) | Threonine (T) |
|---|---|---|---|
| 2 | Aspartic acid (D) | Glutamic acid (E) | |
| 3 | Asparagine (N) | Glutamine (Q) | |
| 4 | Arginine (R) | Lysine (K) | |
| 5 | Isoleucine (I) | Leucine (L) | Methionine (M) |
| 6 | Phenylalanine (F) | Tyrosine (Y) | Tryptophan (W) |

More conservative substitutions exist within the above-described classes and can be alternatively preferred. An example of conservation groups for more conservative substitutions include: valine-leucine-isoleucine, phenylalanine-tyrosine, lysine-arginine, alamine-valine, and asparagine-glutamine. Additional groups of amino acids can also be formulated using the principles described in, e.g., Creighton (1984) *Proteins: Structure and Molecular Properties* (2d Ed. 1993), W. H. Freeman and Company.

Typically, one or more amino acid residues in the immunogenic amino acid sequence of the polypeptide that are not identical to a corresponding residue in at least one of the immunogenic amino acid sequences disclosed herein, such as, e.g., SEQ ID NOS:1-49 and 153-155, usually differ from the most related immunogenic amino acid sequence (e.g., the most related sequence selected from the group of SEQ ID NOS:1-49 and 153-155) by conservative amino acid substitutions, i.e., substitutions with one of more of the groups provided in Table 1 or Table 2 above, or, typically, substitutions that are within a single group in each such table). As such, the disclosure of a polypeptide or protein sequence herein, in conjunction with the above-described conservation groups, provides an express listing of all conservatively substituted polypeptide sequences relating to these sequences.

Typically, the immunogenic amino acid sequence of the polypeptide also exhibits substantial weight homology to one of the immunogenic amino acid sequences of the invention, commonly to at least one of the group of SEQ ID NOS:1-49, 65-116, 139-148, 153-155, 236-253, 343, and 345. Desirably, the immunogenic amino acid sequence has substantially high weight homology with at least 5, preferably at least about 10, or more, of the disclosed immunogenic amino acid sequences of the invention (e.g., about 5, 10 or more sequences selected from any of the above-referenced group of sequences). "Substantial weight homology" means that at least about 60%, preferably at least about 70%, and more preferably at least about 80% (e.g., about 65-85%), or more (e.g., about 87%, 90%, 92%, 95%, or 99%) of the non-identical amino acid residues at a position in the polypeptide are members of the same weight-based "weak conservation group" or "strong conservation group" as the corresponding amino acid in the most identical or functionally homologous sequence among the disclosed immunogenic amino acid sequences of the invention, such as an amino acid sequence selected from the group of and SEQ ID NOS:1-49, 65-116, 139-148, 153-155, 236-253, 343, and 345. Strong group conservation is preferred. Weight-based conservation is determined on the basis of whether the non-identical corresponding amino acid is associated with a positive score on one of the weight-based matrices described herein (e.g., the BLOSUM50 matrix and preferably the PAM250 matrix). Weight-based strong conservation groups include Ser Thr Ala, Asn Glu Gin Lys, Asn His Gin Lys, Asn Asp Glu Gin, Gin His Arg Lys, Met Ile Leu Val, Met Ile Leu Phe, His Tyr, and Phe Tyr Trp. Weight-based weak conservation groups include Cys Ser Ala, Ala Thr Val, Ser Ala Gly, Ser Thr Asn Lys, Ser Thr Pro Ala, Ser Gly Asn Asp, Ser Asn Asp Glu Gin Lys, Asn Asp Glu Gin His Lys, Asn Glu Gin His Arg Lys, Phe Val Leu Ile Met, and His Phe Tyr. The CLUSTALW sequence analysis program provides analysis of weight-based strong conservation and weak conservation groups in its output, and offers the preferred technique for determining weight-based conservation, preferably using the CLUSTALW default settings used by the SDSC.

Alternatively, but typically in addition to either substantial identity or substantial functional homology, the polypeptide comprises an immunogenic amino acid sequence that shares a similar hydropathy profile (or exhibits similar hydrophilicity) to at least one (preferably at least 5, and more preferably at least about 10) of the immunogenic amino acid sequences disclosed herein, such as amino acid sequences selected from the group of SEQ ID NOS:1-49. A hydropathy profile can be determined using the Kyte & Doolittle index, the scores for each naturally occurring amino acid in the index being as follows: I (+4.5), V (+4.2), L (+3.8), F (+2.8), C (+2.5), M (+1.9); A (+1.8), G (−0.4), T (−0.7), S (−0.8), W (−0.9), Y (−1.3), P (−1.6), H (−3.2); E (−3.5), Q (−3.5), D (−3.5), N (−3.5), K (−3.9), and R (−4.5) (see, e.g., U.S. Pat. No. 4,554,101 and Kyte & Doolittle, (1982) *J Molec Biol* 157:105-32 for further discussion). Preferably, at least about 45%, preferably at least about 60%, and more preferably at least about 75% (e.g., at least about 85%, at least about 90%, at least about 91%, at least about 92%, at least about 93%, at least about 94%, at least about 95%, at least about 96%, at least about 97% at least about 98%, or at least about 99%) of the amino acid residues in the immunogenic amino acid sequence that are not identical to the corresponding residues in the most identical or functionally homologous immunogenic amino acid sequence disclosed herein ("most related homolog"), which homolog is preferably selected from any of SEQ ID NOS:1-49, exhibit less than a +/−2 change in hydrophilicity, more preferably less than a +/−1 change in hydrophilicity, and even more preferably less than a +/−0.5 change in hydrophilicity with respect to the non-identical amino acid residue at the corresponding position in the most related homolog. Overall, the polypeptide desirably exhibits a total change in hydrophilicity, with respect to its most related homolog selected from the group of SEQ ID NOS:1-49, 65-116, 139-148, 153-155, and 236-253, of less than about 150, more preferably less than about 100, and even more preferably less than about 50 (e.g., less than about 30, less than about 20, or less than about 10). Examples of typical amino acid substitutions that retain similar or identical hydrophilicity include arginine-lysine substitutions, glutamate-aspartate substitutions, serine-threonine substitutions, glutamine-asparagine substitutions, and valine-leucine-isoleucine substitutions. Algorithms and software, such as the GREASE program available through the SDSC, provide a convenient way for quickly assessing the hydropathy profile of a peptide fragment or peptide portion.

The polypeptide desirably comprises a substantially identical (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity), or at least substantially functionally homologous, immunogenic amino acid sequence to at least one sequence (preferably at least 5 sequences, and more preferably at least about 10 sequences) selected from the group of SEQ ID NOS:1-49, 65-116, 139-148, 153-155, and 236-253, wherein at least about 90%, preferably at least about 95%, and more preferably 100% of the amino acid residues in the composition have a Kyte & Doolittle hydropathy score of above 0, and more preferably of at least about 1.

Recombinant Truncated E Protein and Full Length E Protein Polypeptides

The invention also provides a recombinant polypeptide comprising an amino acid sequence that has that has at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5%, or more amino acid sequence identity to an amino acid sequence of at least one of SEQ ID NOS:1-49 and 153-155. Such a polypeptide is usually referred to as a recombinant truncated envelope (E) protein polypeptide (or "truncated E" or "tE" polypeptide) as described above. The invention also provides recombinant E polypeptides of the invention that have a sequence length equivalent to or substantially equivalent to (e.g., within about 85%, 87%, 88%, 90%, 92% or more of) the length of the amino acid sequence of an envelope protein of a wild-type flavivirus, e.g., preferably a dengue virus envelope protein. Such a polypeptide is usually referred to as a recombinant full length E protein polypeptide ("full length E," "fill E" or "E" polypeptide).

In another aspect, the invention provides a polypeptide that comprises an amino acid sequence that is substantially identical to at least one of SEQ ID NOS:2, 3, 5, 25, 29, and 44-46. Such a polypeptide comprises an amino acid sequence that has at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5%, or more amino acid sequence identity with at least one of SEQ ID NOS:2, 3, 5, 25, 29, and 44-46. Desirably, the polypeptide comprises an amino acid sequence that has at least about 85%, at least about 90%, at least about 95%, or more amino acid sequence identity with 3, 5, or more sequences selected from any of SEQ ID NOS:2, 3, 5, 25, 29, and 44-46. In one preferred aspect, the polypeptide can comprise, consist essentially of, or consist entirely of an amino acid sequence according of any one of SEQ ID NOS:2, 3, 5, 25, 29, and 44-46.

In a particular aspect, the invention provides a polypeptide that comprises an immunogenic amino acid sequence that is substantially identical (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) to SEQ ID NOS:2, 5 or 25. Desirably, the amino acid sequence has at least about 85%, more preferably at least about 90%, and even more preferably at least about 95%, or more (e.g., 97%, 98%, or 99.5%) sequence identity with SEQ ID NO:5. The invention includes a polypeptides comprising SEQ ID NO:2, 5, or 25.

Some such recombinant truncated E polypeptides or recombinant full length E polypeptides of the invention polypeptide induce, promote, or enhance an immune response in a subject (e.g., mammal), or population of cells of a subject, against at least one dengue virus of at least one serotype selected from the group of dengue-1, dengue-2, dengue-3, and dengue-4. Some such polypeptides induce an immune response in a subject against at least one dengue virus of each of at least two, three, or four serotypes selected from the group of dengue-1, dengue-2, dengue-3, and dengue-4.

Some such recombinant truncated E or full length E polypeptides induce an immune response in a subject at least one dengue virus of at least one serotype selected from the group of dengue-1, dengue-2, dengue-3, and dengue-4 that is about equal to or greater than an immune response induced in the subject against the at least one dengue virus of the at least one serotype by a WT truncated E protein of each said at least one dengue virus, wherein said WT truncated E protein has an amino acid sequence length substantially equivalent to that of the recombinant or synthetic polypeptide. The WT truncated E proteins of dengue-1, dengue-2, dengue-3, and dengue-4 can comprise the amino acid sequences consisting essentially of SEQ ID NO:338, 339, 340, and 341, respectively.

Some such polypeptides induce an immune response in a subject, or population of cells of the subject, against at least one dengue virus of each of at least two or three serotypes that is about equal to or greater than an immune response induced in the subject or cells by a WT truncated E protein of at least one dengue virus of each of the at least two or three serotypes, respectively, against at least one dengue virus of each of said at least three serotypes.

Preferably, a recombinant truncated E polypeptide induces an immune response in the subject or cells thereof against at least one dengue virus of each of the four serotypes that is about equal to or greater than an immune response induced in the subjects or its cells by any of SEQ ID NOS:338-341 against at least one dengue virus of each of the four serotypes.

Some such recombinant truncated E and full length E polypeptides induce production of one or more antibodies that bind to at least one dengue virus of at least one dengue virus serotype. Preferably, such a polypeptide induce production of one or more antibodies that bind to at least one dengue virus of each of at least two, more preferably three, or even more preferably four serotypes. In one particular aspect, a recombinant truncated E or full length E polypeptide induces production of a number of antibodies that bind to at least one dengue virus of at least one, two, three, or serotypes that is about equal to or greater than the number of antibodies induced by a wild-type truncated E protein or full length E protein of the at least one dengue virus of the at least one serotype, respectively. In a preferred aspect, a recombinant truncated E or full length E polypeptide induces production of a number of antibodies that bind to at least one dengue virus of each of at least one, preferably at least two, more preferably at least three, and even more preferably at least four serotypes that is about equal to or greater than the number of antibodies induced by a wild-type truncated E protein or full length E protein of the at least one dengue virus of each of the at least one, two, three or four serotypes, respectively.

Some such recombinant truncated E and full length E polypeptides induce the production of one or more antibodies that bind more specifically to at least one dengue virus of the at least one serotype than is induced by a wild-type truncated E or full length E protein, respectively, of the at least one dengue virus of the at least one serotype.

In another aspect, some such recombinant truncated E or full length E polypeptide of the invention induce or produce a titer of neutralizing antibodies against at least one dengue virus of each of at least one, preferably at least two, more preferably at least three, and even more preferably at least four dengue virus serotypes. Some such polypeptides induce or produce a titer of neutralizing antibodies against at least one dengue virus of at least one serotype that is about equal to or greater than a titer of neutralizing antibodies produced against the at least one dengue virus of the at least one serotype by a wild-type truncated E protein of the at least one dengue virus of the at least one serotype, wherein each said wild-type truncated E protein is selected from the group of SEQ ID NOS:338-341. Some such polypeptides induce or produce a titer of neutralizing antibodies against at least one dengue virus of each of at least two, at least three, or at least four serotypes that is about equal to or greater than a titer of neutralizing antibodies produced against the at least one dengue virus of each of the at least two, at least three, or at least four serotypes by a wild-type truncated E protein of the at least one dengue virus of each of the at least two, at least three, or at least four serotypes, respectively, wherein each said wild-type truncated E protein is selected from the group of SEQ ID NOS:338-341.

The invention provides recombinant truncated E polypeptides and recombinant full length E proteins having any of the aforementioned characteristics and characteristics described herein (or any combination of such characteristics), in addition to polypeptides having the additional or alternative characteristics attendant polypeptides of the invention as described further herein.

A polypeptide of the invention can comprise an immunogenic amino acid sequence of any length (e.g., about 10-1500 amino acids, more typically about 50-1000 amino acids, and even more frequently about 100-800 amino acids). Typically, the immunogenic amino acid sequence of the invention is at least about 100, more typically at least about 150, frequently about 200, more frequently about 250, usually at least about 300, more usually at least about 350, and even more usually (and typically preferably) at least about 400 amino acids in length (e.g., about 400-750 amino acids in length, more typically about 425-685 amino acids in length for recombinant truncated E protein polypeptides, and commonly about 425 to about 450 amino acids in length for recombinant truncated E protein polypeptides of the invention, about 435 to about 460 or about 465 for recombinant PRM15/truncated E polypeptides of the invention, and about 650 to about 680 or about 700 amino acids in length for C15/full prM/full E polypeptides of the invention, as are further discussed above and below).

Signal Peptide Sequences

Recombinant truncated E polypeptides and recombinant full length E polypeptides of the invention can also or alternatively comprise any suitable number and type of additional amino acid sequences, such as one or more peptide fragments. In one embodiment, for example, such truncated E or full length E polypeptide further comprises a signal peptide. Generally, the signal peptide directs the recombinant or synthetic polypeptide to the endoplasmic reticulum when the recombinant or synthetic polypeptide is expressed in an animal cell. The inclusion of a signal sequence, which typically directs organelle trafficking and/or secretion of at least a portion of the polypeptide upon expression in a cell is particularly preferred. Such sequences are typically present in the immature (i.e., not fully processed) form of the polypeptide, and are subsequently removed/degraded by cellular proteases to arrive at the mature form of the protein. For example, the truncated E or full length E polypeptide can include any suitable signal sequence or combinations of signal sequences that direct the polypeptide to intracellular compartments, such as a sequence that directs the polypeptide to be transported (e.g., translocated) into (preferably such that the protein is processed by and released from) the endoplasmic reticulum or secretory pathway (e.g., the ER, golgi, and other secretory related organelles and cellular compartments), the nucleus, and/or which directs the polypeptide to be secreted from the cell, translocated in a cellular membrane, or target a second cell apart from the cell the protein is secreted from. In this respect, the polypeptide can include an intracellular targeting sequence (or "sorting signal") that directs the polypeptide to an endosomal and/or lysosomal compartment(s) or other compartment rich in MHC II to promote CD4+ and/or CD8+ T cell presentation and response, such as a lysosomal/endosomal-targeting sorting signal derived from lysosomal associated membrane protein 1 (e.g., LAMP-1—see, e.g., Wu et al. *Proc. Natl. Acad. Sci. USA* 92:1161-75 (1995) and Ravipraskash et al., *Virology* 290:74-82 (2001)), a portion or homolog thereof (see, e.g., U.S. Pat. No. 5,633,234), or other suitable lysosomal, endosomal, and/or ER targeting sequence (see, e.g., U.S. Pat. No. 6,248,565). In some aspects, it may be desirable for the intracellular targeting sequence to be located near or adjacent to a proven/identified anti-dengue virus T-cell epitope sequence(s) within the polypeptide, which can be identified by techniques known in the art and described herein, thereby increasing the likelihood of T cell presentation of polypeptide fragments that comprise such epitope(s). Preferably, such polypeptides are expressed from recombinant, synthetic, mutant and/or isolated DNA or RNA delivered to a host cell by one or more of the nucleotide or viral nucleotide transfer vectors, including, e.g., one or more of the gene transfer vectors, described further herein.

Preferably, the polypeptide comprises a signal sequence that directs the polypeptide to the endoplasmic reticulum (ER) (e.g., facilitates ER translocation of the polypeptide) when the polypeptide is expressed in a mammalian cell. The polypeptide can comprise any suitable ER-targeting sequence. Many ER-targeting sequences are known in the art. Examples of such signal sequences are described in U.S. Pat. No. 5,846,540. Commonly employed ER/secretion signal sequences include the STII or Ipp signal sequences of *E. coli*, yeast alpha factor signal sequence, and mammalian viral signal sequences such as herpes virus gD signal sequence. Further examples of signal sequences are described in, e.g., U.S. Pat. Nos. 4,690,898, 5,284,768, 5,580,758, 5,652,139, and 5,932,445. Suitable signal sequences can be identified using skill known in the art. For example, the SignalP program (described in, e.g., Nielsen et al. (1997) *Protein Engineering* 10:1-6), which is publicly available through the Center for Biological Sequence Analysis at http://www.cbs.dtu.dk/services/SignalP, or similar sequence analysis software capable of identifying signal-sequence-like domains can be used. Related techniques for identifying suitable signal peptides are provided in Nielsen et al., *Protein Eng.* 10(1): 1-6 (1997). Sequences can be manually analyzed for features commonly associated with signal sequences, as described in, e.g., European Patent Application 0 621 337, Zheng and Nicchitta (1999) *J Biol Chem* 274(51): 36623-30, and Ng et al. (1996) *J Cell Biol* 134(2):269-78.

Recombinant truncated polypeptides having the above-described characteristics typically comprise an immunogenic amino acid sequence that is shorter in amino acid length than the dengue virus envelope protein; that is, the immunogenic amino acid sequence comprises one or more residues less than the total number of residues of a dengue virus envelope protein. Particularly, the immunogenic amino acid of such proteins is typically about 65-95%, and more typically about 80-90%, of the size of a dengue virus envelope protein (determined by number of residues in the respective proteins), preferably in combination with an ER-targeting signal sequence that usually has a size equal to about 5-20% of a dengue virus prM sequence (useful fragments of such amino acid sequences also provided by the invention are discussed further herein). Such truncated E polypeptides often lack at least a portion of the dengue virus E protein C-terminal transmembrane sequence or a functional and/or structural homolog thereof. Proteins having such characteristics can exhibit different secretion qualities than a protein that comprise such a sequence.

The invention also provides recombinant polypeptides comprising an immunogenic amino acid sequence that is equivalent to or similar in length to a complete or full length flavivirus envelope protein, preferably a dengue virus envelope protein. Such amino acid sequences can be referred to as "partial full length" and "full length" E polypeptide sequences, respectively, in contrast to the above-described "truncated" E sequences that comprise an immunogenic amino acid sequence that is equivalent to or similar in length to a truncated envelope protein of a flavivirus, such as a dengue virus. In addition, as described below, the invention also provides polypeptides comprising such a full length immunogenic sequence that further includes a signal peptide sequence.

In one embodiment, a recombinant truncated E polypeptide or full length E polypeptide of the invention further comprises a signal peptide sequence, wherein the signal peptide sequence comprises, or consists essentially of, an amino acid sequence of at least about 10 (e.g., about 8-20) amino acid residues in length that has at least about 50% (preferably at least about 60%, 65%, 70%, 80%, 85%, 90%, 95%, 98%, or more) and even more preferably at least about 85-95% amino acid sequence identity to the C-terminal 5-20% of a flavivirus prM protein sequence. For example, in one aspect, such signal peptide comprises the last 15 amino acid residues of the C terminus of the flavivirus prM protein sequence (e.g., dengue prM protein sequence). Any suitable flavivirus C-terminal prM sequence can be used as the basis for a signal peptide. The flaviviruses are discussed in, e.g., FIELDS VIROLOGY, supra, VIROLOGY, B. N. Fields et al., eds., Raven Press, Ltd., New York (3rd ed., 1996 and 4th ed., 2001) and the ENCYCLOPEDIA OF VIROLOGY, R. G. Webster et al., eds., Academic Press (2nd ed., 1999). Several flaviviral prM sequences also are known (see, e.g., Despres et al. (1990) *Virus Res* 16(1):59-75, Venugopal et al. (1995) Vaccine August; 13(11):1000-5, International Patent Application WO 01/39802, and GenBank Accession Nos. AAK97602, AAD28623, GNWVTB, BAA23792, BAA23784, BAA08221, BAA08220 and AAF34187). The C-terminal portions of these and other flavivirus prM signal sequences or substantially identical homologs (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) thereof can be generated by standard DNA synthesis techniques (homologs can be generated through directed mutagenesis, recursive sequence recombination, rational sequence design, or any other suitable technique, examples of which are discussed further herein) and fused to sequences encoding the amino acid sequence (e.g., a sequence encoding the C-terminal-most 10-20 amino acids of a yellow fever virus, or homolog thereof, can be fused to a sequence encoding any one of SEQ ID NOS:1-49 and 153-155). Introduction of a start codon to the 5' end of such a prM sequence typically adds an N-terminal methionine to the amino acid sequence when expressed in a mammalian cell (other modifications may occur in bacterial and/or other eukaryotic cells, such as introduction of an formyl-methionine residue at a start codon). The inventors contemplate the production and use of such N-terminal methionine sequences in most aspects where the polypeptide comprises or consists essentially of the amino acid sequence or at least the N-terminus thereof. Standard nucleic acid synthesis techniques are known in the art (see, e.g., Beaucage and Caruthers, *Tetrahedron Let* 22:1859-1869 (1981), Mathers et al., *EMBO J.* 3:801-805 (1984), Saiki et al., *Science* 239:487-491 (1988) U.S. Pat. No. 4,683,202, and other references cited herein).

In one aspect, the recombinant truncated E polypeptide or full length E polypeptide further comprises a signal peptide, which signal peptide comprises a signal sequence of about 5-25 amino acids (e.g., about 15 amino acids, typically about 10-20 amino acids) that has at least about 50% or at least about 60%, preferably at least about 70%, 80%, or 85% (e.g., at least about 65 to about 95%), and more preferably at least about 90%, 91%, 92%, 93%, 94%, 95%, 96%, 97%, 98%, or 99% or more amino acid sequence identity to an amino acid sequence comprising the C-terminal most 15 amino acids of the prM protein selected from the group of DEN-1 prM, DEN-2 prM, DEN-3 prM, and DEN-4 prM or to an amino acid sequence comprising a methionine residue following by the C-terminal most 15 amino acids of the prM protein selected from the group of DEN-1 prM, DEN-2 prM, DEN-3 prM, and DEN-4 prM (SEQ ID NOS:52-55, respectively). Such amino acid sequences that comprise a methionine residue followed by 15 amino acid residues are typically termed a "PRM15" sequence. In another aspect, the signal peptide comprises a signal sequence that comprises an amino acid sequence of similar size that exhibits at least about 55% amino acid sequence identity (preferably at least about 65%, more preferably at least about 75%, and even more preferably at least about 85%, at least about 90%, at least about 95% (e.g., about 80-99%) to at least one of SEQ ID NOS:52-64. In one aspect, the signal peptide comprises a signal sequence selected from any of SEQ ID NOS:52-64. The positioning of the signal sequence within the recombinant truncated E polypeptide or full length E polypeptide depends on the type of signal sequence used. The functionality of signal sequences is often position dependent, with respect to the remainder of the protein. Preferably, the signal peptide sequence is positioned N-terminal to the immunogenic E polypeptide sequence, particularly where the signal sequence is a flaviviral prM sequence or homolog thereof. The signal peptide sequence can be incorporated in any suitable portion of the polypeptide that allows the signal sequence to carry out its desired targeting function. Typically and preferably, the signal peptide sequence is positioned near to (e.g., within about 20 amino acids or less) the recombinant immunogenic amino acid sequence (e.g., the truncated E polypeptide or full length E polypeptide), or, more desirably, is directly fused to the N-terminus of the immunogenic amino acid sequence. In some instances, other heterologous domains or linkers can be positioned between the signal sequence and the immunogenic E polypeptide. Inclusion of such elements is further discussed elsewhere herein.

PRM15/Truncated E Polypeptides and PRM15/Full Length E Polypeptides

Recombinant E truncated polypeptides comprising a dengue virus prM signal peptide sequence or homolog thereof (e.g., signal peptide sequence of any of SEQ ID NOS:52-64) are typically designated signal peptide/truncated E polypeptides, or signal peptide/full length E polypeptides. In a particular format, where the signal peptides comprises the 15 C-terminal amino acid residues of a flavivirus (e.g., dengue virus) prM protein, a recombinant polypeptide comprising such signal peptide and either a recombinant truncated E polypeptide or full length E polypeptide of the invention is termed, respectively, a PRM15/truncated E protein polypeptide (also termed "PRM15/truncated E" polypeptide or "PRM15/tE" polypeptide) or a PRM15/full length E protein polypeptide (also termed "PRM15/fill length E" polypeptide or "PRM15/full E" polypeptide). The PRM15 sequence is typically fused to the first amino acid of the truncated E or full length E polypeptide. In addition, PRM15/tE and PRM15/full length E polypeptide sequences typically include a methionine residue as the first amino acid of the sequence.

Polypeptides of the invention comprising a recombinant truncated E polypeptide or full length E polypeptide of the invention and a signal sequence desirably comprise an amino acid sequence that has at least about 65%, at least about 70%, preferably at least about 80%, preferably at least about 85%, 87%, or 89%, more preferably at least about 90%, 91%, 92%, 93%, or 94%, and even more preferably at least about 95% amino acid sequence identity to at least one of SEQ ID NOS: 65-116 (such identity taking into account both the prM fragment or portion, such as, e.g., PRM15 fragment, and the remaining, immunogenic amino acid sequence of the truncated E polypeptide). In one embodiment, such a polypeptide comprises an amino acid that has at least about 75% (e.g., about 80% to 100%), desirably at least about 85%, favorably at least about 90%, and more desirably at least about 95% amino acid sequence identity with at least one of SEQ ID NOS:66, 67, 69, 89, 93, and 108-110. Preferably, the polypeptide comprises an amino acid sequence selected from the group of SEQ ID NOS:65-116 or an amino acid sequence that is at least about 95%, 98%, 99%, or more identical with of SEQ ID NOS:65-116. Even more preferably, the polypeptide comprises an amino acid sequence selected from (or having at least about 98%, about 99%, or more identity with) SEQ ID NOS:66, 67, 69, 89, 93, and 108-110.

In another aspect, the invention provides a recombinant or synthetic polypeptide comprising an amino acid sequence that has at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5%, or more amino acid sequence identity to the amino acid sequence of at least one of SEQ ID NOS:65-116, wherein recombinant or synthetic polypeptide induces an immune response in a subject against at least one dengue virus of at least one serotype selected from the group of dengue-1, dengue-2, dengue-3, and dengue-4.

Some such PRM15/truncated E or PRM15/full length E polypeptides induce an immune response in a subject, or population of cells of the subject, against at least one dengue virus of at least one serotype selected from the group of dengue-1, dengue-2, dengue-3, and dengue-4 that is about equal to or greater than an immune response induced against the at least one dengue virus of the at least one serotype by a wild-type PRM15/truncated E or wild-type PRM15/full E polypeptide, respectively, of the at least one serotype. In one aspect, each wild-type PRM15/truncated E protein polypeptide is selected from SEQ ID NOS:149-152. Some such PRM15/truncated E or PRM15/full E polypeptides induce an immune response in a subject or its cells against at least one dengue virus of each of at least two, at least three, or preferably at least four serotypes that is about equal to or greater than an immune response induced in the subjects or cells thereof against the at least one dengue virus of each of the at least two, at least three, or at least four serotypes, respectively, by a wild-type PRM15/truncated E polypeptide or wild-type PRM15/full E polypeptide of each of the at least two, at least three, or at least four serotypes, respectively. Some such PRM15/tE polypeptides comprise an amino acid sequence that has at least about 90% amino acid sequence identity to the sequence of at least one of SEQ ID NOS:66, 67, 69, 89, 93, and 108-110. In one particular aspect, the polypeptide comprises an amino acid sequence selected from the group of SEQ ID NOS:66, 67, 69, 89, 93, and 108-110.

Some such PRM15/tE and full E polypeptides induces production of one or more antibodies that bind to at least one dengue virus of at least 1, at least 2, preferably at least 3, and more preferably at least 4 dengue virus serotypes (e.g., dengue-1, dengue-2, dengue-3, and/or dengue-4). In one aspect, the number of antibodies produced by a PRM15/truncated E polypeptide that bind to at least one dengue virus of at least one serotype equal to or greater than the number of antibodies induced by a WT PRM15/truncated E protein (also referred to as "PRM15/truncated E polypeptide") of the at least one serotype, wherein each WT PRM15/truncated E protein polypeptide is selected from SEQ ID NOS:149-152.

Some such PRM15/tE polypeptides, which typically comprise an amino acid sequence that has at least about 90% sequence identity to the sequence of at least one of SEQ ID NOS:65-116, induce production of a number of antibodies that bind to at least one dengue virus of each of the at least two or three serotypes that is about equal to or greater than is induced by a wild-type PRM15/truncated E fusion protein of each of the at least two or three serotypes, wherein each wild-type PRM15/truncated E fusion protein of the selected serotype is selected from SEQ ID NOS:149-152. For some such polypeptides, the induced number of antibodies that bind to at least one dengue virus of each of the at least four serotypes is about equal to or greater than is induced by any of SEQ ID NOS:149-152.

Furthermore, some such PRM15/tE polypeptide induces production of one or more antibodies that bind more specifically to at least one dengue virus of at least one serotype than is induced by a wild-type PRM15/truncated E polypeptide of the at least one dengue virus of the at least one serotype, wherein the particular wild-type PRM15/truncated E fusion protein is selected from SEQ ID NOS:149-152.

In another aspect, recombinant PRM15/tE polypeptides and PRM15/full length E polypeptides of invention induce or produce a titer of neutralizing antibodies against at least one dengue virus of at least one dengue virus serotype, preferably at least one dengue virus of each of at least two serotypes, more preferably at least one dengue virus of each of at least three serotypes, and even more preferably at least one dengue virus of each of at least four serotypes selected from dengue-1, dengue-2, dengue-3, and dengue-4.

In one aspect of the invention, the titer of neutralizing antibodies that is about equal to or greater than a titer of neutralizing antibodies produced by the PRM15/tE or PRM15/tE polypeptide against at least one dengue virus of at least one serotype at least is equal or greater than that produced by a wild-type PRM15/truncated E polypeptide or wild-type PRM15/full E polypeptide of the at least one dengue virus of the at least one serotype.

In one particular aspect, for some such PRM15/tE polypeptides, the titer of antibodies induced against at least one dengue virus of each of at least two, three, or four dengue virus serotypes is equal to or greater than against at least one dengue virus of at least one serotype at least is equal or greater than that induced by a wild-type PRM15/truncated E polypeptide of the same dengue virus of each of the at least two, three, or four serotypes, wherein the particular wild-type PRM15/truncated E polypeptide of the same serotype (for comparison) fusion protein is selected from SEQ ID NOS: 149-152.

Some such PRM15/tE polypeptides induce at least one neutralizing antibody response in a mammal to or against at least one dengue virus of each of at least two, three or four serotypes without an occurrence of antibody-dependent enhancement (ADE) upon contact of the mammal with the at least dengue virus of each of the at least two, three, or four serotypes, respectively.

In one aspect of the invention, a recombinant polypeptide that induces a neutralizing antibody response against all four dengue virus serotypes comprises an amino acid sequence having at least about 90% sequence identity to the amino acid sequence of at least one of SEQ ID NOS:66, 67, 69, 89, 93, and 108-110.

In another aspect, the invention further provides a recombinant PRM15/truncated E polypeptide that comprises an immunogenic amino acid sequence of the sequence pattern Met Xaa$_1$ Xaa$_2$ Xaa$_3$ Phe Ile Leu Xaa$_4$ Met Leu Val Xaa$_5$ Pro Ser Xaa$_6$ Xaa$_7$ Met Arg Cys Xaa$_8$ Gly Xaa$_9$ Xaa$_{10}$ Asn Xaa$_{11}$ Asp Phe Val Glu Gly Xaa$_{12}$ Ser Gly Xaa$_{13}$ Xaa$_{14}$ Trp Val Asp Xaa$_{15}$ Val Leu Glu His Gly Xaa$_{16}$ Cys Val Thr Thr Met Ala Xaa$_{17}$ Xaa$_{18}$ Lys Pro Thr Leu Asp Xaa$_{19}$ Glu Leu Xaa$_{20}$ Lys Thr Xaa$_{21}$ Xaa$_{22}$ Xaa$_{23}$ Xaa$_{24}$ Xaa$_{25}$ Ala Xaa$_{26}$ Leu Arg Xaa$_{27}$ Xaa$_{28}$ Cys Ile Glu Ala Xaa$_{29}$ Xaa$_{30}$ Xaa$_{31}$ Asn Xaa$_{32}$ Thr Thr Xaa$_{33}$ Xaa$_{34}$ Arg Cys Pro Thr Gln Gly Glu Xaa$_{35}$ Xaa$_{36}$ Xaa$_{37}$ Xaa$_{38}$ Glu Glu Gln Asp Xaa$_{39}$ Xaa$_{40}$ Xaa$_{41}$ Xaa$_{42}$ Cys Xaa$_{43}$ Xaa$_{44}$ Xaa$_{45}$ Xaa$_{46}$ Val Asp Arg Gly Trp Gly Asn Gly Cys Gly Leu Phe Gly Lys Gly Xaa$_{47}$ Xaa$_{48}$ Xaa$_{49}$ Thr Cys Ala Xaa$_{50}$ Phe Xaa$_{51}$ Cys Xaa$_{52}$ Xaa$_{53}$ Xaa$_{54}$ Xaa$_{55}$ Glu Gly Xaa$_{56}$ Xaa$_{57}$ Val Gln Xaa$_{58}$ Glu Asn Leu Xaa$_{59}$ Tyr Xaa$_{60}$ Xaa$_{61}$ Xaa$_{62}$ Xaa$_{63}$ Thr Xaa$_{64}$ His Xaa$_{65}$ Gly Xaa$_{66}$ Xaa$_{67}$ His Xaa$_{68}$ Val Gly Asn Xaa$_{69}$ Thr Xaa$_{70}$ Xaa$_{71}$ Xaa$_{72}$ Gly Xaa$_{73}$ Xaa$_{74}$ Xaa$_{75}$ Xaa$_{76}$ Ile Thr Pro Gln Xaa$_{77}$ Xaa$_{78}$ Xaa$_{79}$ Xaa$_{80}$ Glu Xaa$_{81}$ Xaa$_{82}$ Leu Xaa$_{83}$ Xaa$_{84}$ Tyr Gly Xaa$_{85}$ Xaa$_{86}$ Xaa$_{87}$ Xaa$_{88}$ Xaa$_{89}$ Cys Ser Pro Arg Thr Gly Leu Asp Phe Asn Xaa$_{90}$ Xaa$_{91}$ Xaa$_{92}$ Leu Xaa$_{93}$ Xaa$_{94}$ Met Lys Xaa$_{95}$ Lys Xaa$_{96}$ Trp Xaa$_{97}$ Val His Xaa$_{98}$ Gln Trp Xaa$_{99}$ Xaa$_{100}$ Asp Leu Pro Leu Pro Trp Thr Xaa$_{101}$ Gly Ala Xaa$_{102}$ Thr Xaa$_{103}$ Xaa$_{104}$ Xaa$_{105}$ Xaa$_{106}$ Trp Asn Xaa$_{107}$ Lys Glu Xaa$_{108}$ Xaa$_{109}$ Val Thr Phe Lys Xaa$_{110}$ Xaa$_{111}$ His Ala Lys Xaa$_{112}$ Gln Xaa$_{113}$ Val Xaa$_{114}$ Val Leu Gly Ser Gln Glu Gly Xaa$_{115}$ Met His Xaa$_{116}$ Ala Leu Xaa$_{117}$ Gly Xaa$_{118}$ Thr Glu Xaa$_{119}$ Xaa$_{120}$ Xaa$_{121}$ Xaa$_{122}$ Xaa$_{123}$ Gly Xaa$_{124}$ Thr Xaa$_{125}$ Xaa$_{126}$ Phe Xaa$_{127}$ Gly Xaa$_{128}$ Leu Lys Cys Xaa$_{129}$ Xaa$_{130}$ Xaa$_{131}$ Met Xaa$_{132}$ Lys Leu Xaa$_{133}$ Xaa$_{134}$ Lys Gly Xaa$_{135}$ Ser Tyr Xaa$_{136}$ Met Cys Thr Gly Xaa$_{137}$ Phe Xaa$_{138}$ Xaa$_{139}$ Xaa$_{140}$ Lys Glu Xaa$_{141}$ Ala Glu Thr Gln His Gly Thr Xaa$_{142}$ Xaa$_{143}$ Xaa$_{144}$ Xaa$_{145}$ Val Xaa$_{146}$ Tyr Xaa$_{147}$ Gly Xaa$_{148}$ Xaa$_{149}$ Xaa$_{150}$ Pro Cys Lys Ile Pro Xaa$_{151}$ Xaa$_{152}$ Xaa$_{153}$ Xaa$_{154}$ Asp Xaa$_{155}$ Xaa$_{156}$ Xaa$_{157}$ Xaa$_{158}$ Xaa$_{159}$ Xaa$_{160}$ Xaa$_{161}$ Gly Arg Leu Ile Thr Xaa$_{162}$ Asn Pro Xaa$_{163}$ Val Xaa$_{164}$ Xaa$_{165}$ Lys Xaa$_{166}$ Xaa$_{167}$ Pro Val Asn Ile Glu Xaa$_{168}$ Glu Pro Pro Phe Gly Xaa$_{169}$ Ser Xaa$_{170}$ Ile Xaa$_{171}$ Xaa$_{172}$ Gly Xaa$_{173}$ Xaa$_{174}$ Xaa$_{175}$ Xaa$_{176}$ Xaa$_{177}$ Leu Xaa$_{178}$ Xaa$_{179}$ Xaa$_{180}$ Trp Xaa$_{181}$ Xaa$_{182}$ Lys Gly Ser Ser Ile Gly Xaa$_{183}$ Met Phe Glu Xaa$_{184}$ Thr Xaa$_{185}$ Arg Gly Ala Xaa$_{186}$ Arg Met Ala Ile Leu Gly Xaa$_{187}$ Thr Ala Trp Asp Xaa$_{188}$ Gly Ser Xaa$_{189}$ Xaa$_{190}$ Xaa$_{191}$ Xaa$_{192}$ Xaa$_{193}$ Xaa$_{194}$ Xaa$_{195}$ Xaa$_{196}$ Xaa$_{197}$ Xaa$_{198}$ Xaa$_{199}$ Xaa$_{200}$ Xaa$_{201}$ Xaa$_{202}$ Xaa$_{203}$ Xaa$_{204}$ Xaa$_{205}$ Xaa$_{206}$ Xaa$_{207}$ Xaa$_{208}$ Xaa$_{209}$ Xaa$_{210}$ Xaa$_{211}$ Xaa$_{212}$ Xaa$_{213}$ (SEQ ID NO:51) wherein Xaa at a particular position represents either any or no amino acid residue at that position (typically and preferably, less than twenty of the variable positions are single residue deletions—i.e., represent no amino acid at the indicated position). Preferably, the polypeptide in this aspect typically is characterized by the presence of naturally occurring amino acids, and preferably amino acids that have a hydropathy score above 0. Preferred amino acids for each of the variable positions (as designated by the subscripted numbers in the sequence pattern) are set forth in Table 3.

TABLE 3

| | | |
|---|---|---|
| $X_1$: A V T G | $X_2$: V I | $X_3$: I F |
| $X_4$: L M | $X_5$: A T | $X_6$: Y M |
| $X_7$: A T G | $X_8$: V I | $X_9$: V I T |
| $X_{10}$: S G | $X_{11}$: R G | $X_{12}$: L V |
| $X_{13}$: A G | $X_{14}$: A T S | $X_{15}$: L V |
| $X_{16}$: S G | $X_{17}$: K R Q | $X_{18}$: G N |
| $X_{19}$: I F | $X_{20}$: L I Q | $X_{21}$: T I E |
| $X_{22}$: A V | $X_{23}$: K T | $X_{24}$: Q E N |
| $X_{25}$: L V P | $X_{26}$: L V T | $X_{27}$: K T |

TABLE 3-continued

| | | |
|---|---|---|
| $X_{28}$: L Y | $X_{29}$: K S | $X_{30}$: L I |
| $X_{31}$: T S | $X_{32}$: I T | $X_{33}$: A E D |
| $X_{34}$: T S | $X_{35}$: A P | $X_{36}$: I T Y N |
| $X_{37}$: L M | $X_{38}$: K V P | $X_{39}$: T Q |
| $X_{40}$: Q N | $X_{41}$: F Y | $X_{42}$: V I |
| $X_{43}$: K R | $X_{44}$: H R | $X_{45}$: T S D |
| $X_{46}$: V F Y M | $X_{47}$: S G | $X_{48}$: L V I |
| $X_{49}$: V I | $X_{50}$: K M | $X_{51}$: K T Q |
| $X_{52}$: L V K | $X_{53}$: K T E | $X_{54}$: K P N |
| $X_{55}$: L I M | $X_{56}$: K N | $X_{57}$: V I |
| $X_{58}$: H P Y | $X_{59}$: K E | $X_{60}$: T S |
| $X_{61}$: V I | $X_{62}$: V I | $X_{63}$: V I |
| $X_{64}$: V P | $X_{65}$: T S | $X_{66}$: E D |
| $X_{67}$: Q E | $X_{68}$: A Q | $X_{69}$: E D |
| $X_{70}$: T S G - | $X_{71}$: K E N - | $X_{72}$: H Q |
| $X_{73}$: V K T | $X_{74}$: T I E | $X_{75}$: A V I |
| $X_{76}$: K T E | $X_{77}$: A S | $X_{78}$: S P |
| $X_{79}$: T I | $X_{80}$: V T S | $X_{81}$: A I |
| $X_{82}$: I Q E | $X_{83}$: T P | $X_{84}$: G E D |
| $X_{85}$: A T | $X_{86}$: L V | $X_{87}$: T G |
| $X_{88}$: L M | $X_{89}$: E D | $X_{90}$: R E |
| $X_{91}$: V M | $X_{92}$: V I | $X_{93}$: L M |
| $X_{94}$: K T | $X_{95}$: K S N | $X_{96}$: A T S |
| $X_{97}$: L M | $X_{98}$: K R G | $X_{99}$: L F |
| $X_{100}$: L F | $X_{101}$: A S | $X_{102}$: T S D |
| $X_{103}$: S E | $X_{104}$: V T Q E | $X_{105}$: V H E P |
| $X_{106}$: T H - | $X_{107}$: H R | $X_{108}$: L R |
| $X_{109}$: L M | $X_{110}$: V T N | $X_{111}$: A P |
| $X_{112}$: K R | $X_{113}$: E D | $X_{114}$: V T |
| $X_{115}$: A T | $X_{116}$: T S | $X_{117}$: A T |
| $X_{118}$: A T | $X_{119}$: V I | $X_{120}$: Q D |
| $X_{121}$: T S N M | $X_{122}$: S G | $X_{123}$: S D |
| $X_{124}$: T N | $X_{125}$: L T H | $X_{126}$: L I M |
| $X_{127}$: A T | $X_{128}$: H R | $X_{129}$: K R |
| $X_{130}$: L V | $X_{131}$: K R | $X_{132}$: E D |
| $X_{133}$: T R Q | $X_{134}$: L I | $X_{135}$: V M |
| $X_{136}$: V T S | $X_{137}$: K S | $X_{138}$: K Q |
| $X_{139}$: L I | $X_{140}$: V E | $X_{141}$: V I |
| $X_{142}$: V I | $X_{143}$: L V | $X_{144}$: V I |
| $X_{145}$: K R Q | $X_{146}$: K Q E | $X_{147}$: K E |
| $X_{148}$: T E D | $X_{149}$: G D | $X_{150}$: A S |
| $X_{151}$: L V F | $X_{152}$: S E | $X_{153}$: I T S |
| $X_{154}$: Q E M | $X_{155}$: L G E | $X_{156}$: K Q E |
| $X_{157}$: K G | $X_{158}$: K V R | $X_{159}$: A T H |
| $X_{160}$: V H Q | $X_{161}$: L N | $X_{162}$: A V |
| $X_{163}$: A V I | $X_{164}$: I T | $X_{165}$: K E D |
| $X_{166}$: E D | $X_{167}$: K S E | $X_{168}$: L A |
| $X_{169}$: E D | $X_{170}$: Y N | $X_{171}$: V I |
| $X_{172}$: V I | $X_{173}$: A V I | $X_{174}$: G E |
| $X_{175}$: E P D | $X_{176}$: K S G | $X_{177}$: A Q |
| $X_{178}$: K T | $X_{179}$: L I | $X_{180}$: S H N |
| $X_{181}$: F Y | $X_{182}$: K R | $X_{183}$: K Q |
| $X_{184}$: A T S | $X_{185}$: A Y M | $X_{186}$: K R |
| $X_{187}$: E D | $X_{188}$: L F | $X_{189}$: A L V I |
| $X_{190}$: G Y | $X_{191}$: T G | $X_{192}$: L V - |
| $X_{193}$: L F - | $X_{194}$: T N - | $X_{195}$: S - |
| $X_{196}$: L V I - | $X_{197}$: G - | $X_{198}$: K - |
| $X_{199}$: A - M | $X_{200}$: L V - | $X_{201}$: H - |
| $X_{202}$: Q - | $X_{203}$: V I - | $X_{204}$: F - |
| $X_{205}$: G - | $X_{206}$: A S - | $X_{207}$: V I - |
| $X_{208}$: F Y - | $X_{209}$: T G - | $X_{210}$: A T S - |
| $X_{211}$: V - M | $X_{212}$: G F - | $X_{213}$: K G - |

As used in Table 3, a dash (-) represents that a single residue deletion can be preferred at the indicated position in the sequence pattern (i.e., the particular position in the sequence pattern can lack any amino acid residue). Desirably, the polypeptide has an amino acid sequence wherein each of the above-identified variable positions is filled by one of the preferred residues listed in Table 2 (or a single residue deletion, if applicable).

In a particularly preferred aspect, the invention provides a recombinant PRM15/truncated E polypeptide comprising an immunogenic amino acid sequence of the sequence pattern Met Xaa$_1$ Xaa$_2$ Xaa$_3$ Phe Ile Leu Xaa$_4$ Met Leu Val Xaa$_5$ Pro Ser Xaa$_6$ Xaa$_7$ Met Arg Cys Val Gly Xaa$_8$ Gly Asn Arg Asp Phe Val Glu Gly Xaa$_9$ Ser Gly Xaa$_{10}$ Xaa$_{11}$ Trp Val Asp Xaa$_{12}$ Val Leu Glu His Gly Xaa$_{13}$ Cys Val Thr Thr Met Ala Lys Asn Lys Pro Thr Leu Asp Xaa$_{14}$ Glu Leu Xaa$_{15}$ Lys Thr Xaa$_{16}$ Xaa$_{17}$ Xaa$_{18}$ Xaa$_{19}$ Xaa$_{20}$ Ala Xaa$_{21}$ Leu Arg Xaa$_{22}$ Xaa$_{23}$ Cys Ile Glu Ala Xaa$_{24}$ Ile Xaa$_{25}$ Asn Xaa$_{26}$ Thr Thr Xaa$_{27}$ Xaa$_{28}$ Arg Cys Pro Thr Gln Gly Glu Xaa$_{29}$ Xaa$_{30}$ Leu Xaa$_{31}$ Glu Glu Gln Asp Xaa$_{32}$ Xaa$_{33}$ Xaa$_{34}$ Xaa$_{35}$ Cys Xaa$_{36}$ Xaa$_{37}$ Xaa$_{38}$ Xaa$_{39}$ Val Asp Arg Gly Trp Gly Asn Gly Cys Gly Leu Phe Gly Lys Gly Ser Xaa$_{40}$ Xaa$_{41}$ Thr Cys Ala Lys Phe Xaa$_{42}$ Cys Xaa$_{43}$ Xaa$_{44}$ Xaa$_{45}$ Xaa$_{46}$ Glu Gly Xaa$_{47}$ Xaa$_{48}$ Val Gln Xaa$_{49}$ Glu Asn Leu Xaa$_{50}$ Tyr Thr Xaa$_{51}$ Xaa$_{52}$ Ile Thr Xaa$_{53}$ His Xaa$_{54}$ Gly Xaa$_{55}$ Xaa$_{56}$ His Xaa$_{57}$ Val Gly Asn Asp Thr Xaa$_{58}$ Xaa$_{59}$ Xaa$_{60}$ Gly Xaa$_{61}$ Xaa$_{62}$ Xaa$_{63}$ Xaa$_{64}$ Ile Thr Pro Gln Xaa$_{65}$ Ser Xaa$_{66}$ Xaa$_{67}$ Glu Ala Xaa$_{68}$ Leu Xaa$_{69}$ Xaa$_{70}$ Tyr Gly Thr Xaa$_{71}$ Xaa$_{72}$ Xaa$_{73}$ Glu Cys Ser Pro Arg Thr Gly Leu Asp Phe Asn Xaa$_{74}$ Xaa$_{75}$ Xaa$_{76}$ Leu Leu Thr Met Lys Xaa$_{77}$ Lys Xaa$_{78}$ Trp Xaa$_{79}$ Val His Xaa$_{80}$ Gln Trp Phe Xaa$_{81}$ Asp Leu Pro Leu Pro Trp Thr Xaa$_{82}$ Gly Ala Xaa$_{83}$ Thr Xaa$_{84}$ Xaa$_{85}$ Xaa$_{86}$ Xaa$_{87}$ Trp Asn Xaa$_8$ g Lys Glu Xaa$_{89}$ Xaa$_{90}$ Val Thr Phe Lys Xaa$_{91}$ Xaa$_{92}$ His Ala Lys Xaa$_{93}$ Gln Xaa$_{94}$ Val Xaa$_{95}$ Val Leu Gly Ser Gln Glu Gly Ala Met His Xaa$_{96}$ Ala Leu Xaa$_{97}$ Gly Ala Thr Glu Xaa$_{98}$ Xaa$_{99}$ Xaa$_{100}$ Xaa$_{101}$ Xaa$_{102}$ Gly Xaa$_{103}$ Xaa$_{104}$ Xaa$_{105}$ Xaa$_{106}$ Phe Xaa$_{107}$ Gly His Leu Lys Cys Xaa$_{108}$ Xaa$_{109}$ Xaa$_{110}$ Met Asp Lys Leu Xaa$_{111}$ Leu Lys Gly Xaa$_{112}$ Ser Tyr Xaa$_{113}$ Met Cys Thr Gly Xaa$_{114}$ Phe Xaa$_{115}$ Xaa$_{116}$ Xaa$_{117}$ Lys Glu Xaa$_{118}$ Ala Glu Thr Gln His Gly Thr Xaa$_{119}$ Xaa$_{120}$ Xaa$_{121}$ Xaa$_{122}$ Val Xaa$_{123}$ Tyr Xaa$_{124}$ Gly Xaa$_{125}$ Xaa$_{126}$ Xaa$_{127}$ Pro Cys Lys Ile Pro Xaa$_{128}$ Xaa$_{129}$ Xaa$_{130}$ Xaa$_{131}$ Asp Xaa$_{132}$ Xaa$_{133}$ Xaa$_{134}$ Xaa$_{135}$ Xaa$_{136}$ Xaa$_{137}$ Xaa$_{138}$ Gly Arg Leu Ile Thr Xaa$_{139}$ Asn Pro Xaa$_{140}$ Val Xaa$_{141}$ Xaa$_{142}$ Lys Xaa$_{143}$ Xaa$_{144}$ Pro Val Asn Ile Glu Xaa$_{145}$ Glu Pro Pro Phe Gly Xaa$_{146}$ Ser Xaa$_{147}$ Ile Xaa$_{148}$ Xaa$_{149}$ Gly Xaa$_{150}$ Xaa$_{151}$ Xaa$_{152}$ Xaa$_{153}$ Xaa$_{154}$ Leu Xaa$_{155}$ Xaa$_{156}$ Xaa$_{157}$ Trp Xaa$_{158}$ Xaa$_{159}$ Lys Gly Ser Ser Ile Gly Xaa$_{160}$ Met Phe Glu Xaa$_{161}$ Thr Xaa$_{162}$ Arg Gly Ala Xaa$_{163}$ Arg Met Ala Ile Leu Gly Xaa$_{164}$ Thr Ala Trp Asp Phe Gly Ser Xaa$_{165}$ Gly Gly Xaa$_{166}$ Xaa$_{167}$ Thr Ser Xaa$_{168}$ Gly Lys Xaa$_{169}$ Xaa$_{170}$ His Gln Xaa$_{171}$ Phe Gly Xaa$_{172}$ Xaa$_{173}$ Tyr Xaa$_{174}$ Xaa$_{175}$ Xaa$_{176}$ Xaa$_{177}$ Xaa$_{178}$ (SEQ ID NO:50), wherein Xaa represents any amino acid residue (usually a naturally occurring amino acid residue, and more preferably an amino acid residue with a hydropathy score of above 0) or a single residue deletion, as described above (typically, less than twenty of the variable positions are single residue deletions—i.e., represent no amino acid at the indicated position).

Preferred amino acids for the each variable positions (as designated by the subscripted numbers in the sequence pattern) are set forth in Table 4.

TABLE 4

| | | |
|---|---|---|
| $X_1$: V T G | $X_2$: V I | $X_3$: I F |
| $X_4$: L M | $X_5$: A T | $X_6$: Y M |
| $X_7$: A T G | $X_8$: V I | $X_9$: L V |
| $X_{10}$: A G | $X_{11}$: A T | $X_{12}$: L V |
| $X_{13}$: S G | $X_{14}$: I F | $X_{15}$: L I |
| $X_{16}$: T E | $X_{17}$: A V | $X_{18}$: K T |
| $X_{19}$: E N | $X_{20}$: V P | $X_{21}$: L V T |
| $X_{22}$: K T | $X_{23}$: L Y | $X_{24}$: K S |
| $X_{25}$: T S | $X_{26}$: I T | $X_{27}$: A D |
| $X_{28}$: T S | $X_{29}$: A P | $X_{30}$: I T Y |
| $X_{31}$: K V P | $X_{32}$: T Q | $X_{33}$: Q N |
| $X_{34}$: F Y | $X_{35}$: V I | $X_{36}$: K R |
| $X_{37}$: H R | $X_{38}$: T D | $X_{39}$: V F Y |
| $X_{40}$: L V | $X_{41}$: V I | $X_{42}$: K T Q |
| $X_{43}$: L V K | $X_{44}$: K T E | $X_{45}$: K P N |
| $X_{46}$: L I M | $X_{47}$: K N | $X_{48}$: V I |
| $X_{49}$: H P | $X_{50}$: K E | $X_{51}$: V I |
| $X_{52}$: V I | $X_{53}$: V P | $X_{54}$: T S |
| $X_{55}$: E D | $X_{56}$: Q E | $X_{57}$: A Q |

TABLE 4-continued

| | | |
|---|---|---|
| $X_{58}$: S G - | $X_{59}$: K N - | $X_{60}$: H Q |
| $X_{61}$: V K | $X_{62}$: T E | $X_{63}$: V I |
| $X_{64}$: K E | $X_{65}$: A S | $X_{66}$: T I |
| $X_{67}$: V T | $X_{68}$: I E | $X_{69}$: T P |
| $X_{70}$: G E | $X_{71}$: L V | $X_{72}$: T G |
| $X_{73}$: L M | $X_{74}$: R E | $X_{75}$: V M |
| $X_{76}$: V I | $X_{77}$: K N | $X_{78}$: A T S |
| $X_{79}$: L M | $X_{80}$: K R | $X_{81}$: L F |
| $X_{82}$: A S | $X_{83}$: T D | $X_{84}$: S E |
| $X_{85}$: T E | $X_{86}$: V P | $X_{87}$: T H |
| $X_{88}$: H R | $X_{89}$: L R | $X_{90}$: L M |
| $X_{91}$: V T N | $X_{92}$: A P | $X_{93}$: K R |
| $X_{94}$: E D | $X_{95}$: V T | $X_{96}$: T S |
| $X_{97}$: A T | $X_{98}$: V I | $X_{99}$: Q D |
| $X_{100}$: S M | $X_{101}$: S G | $X_{102}$: S D |
| $X_{103}$: T N | $X_{104}$: T - | $X_{105}$: L T |
| $X_{106}$: L I | $X_{107}$: A T | $X_{108}$: K R |
| $X_{109}$: L V | $X_{110}$: K R | $X_{111}$: T Q |
| $X_{112}$: V M | $X_{113}$: V T S | $X_{114}$: K S |
| $X_{115}$: K Q | $X_{116}$: L I | $X_{117}$: V E |
| $X_{118}$: V I | $X_{119}$: V I | $X_{120}$: L V |
| $X_{121}$: V I | $X_{122}$: K R Q | $X_{123}$: K Q E |
| $X_{124}$: K E | $X_{125}$: T E D | $X_{126}$: G D |
| $X_{127}$: A S | $X_{128}$: L F | $X_{129}$: S E |
| $X_{130}$: T I S | $X_{131}$: Q E M | $X_{132}$: L G E |
| $X_{133}$: K Q E | $X_{134}$: K G | $X_{135}$: V K R |
| $X_{136}$: A T H | $X_{137}$: V H Q | $X_{138}$: L N |
| $X_{139}$: A V | $X_{140}$: V I | $X_{141}$: T I |
| $X_{142}$: K E D | $X_{143}$: E D | $X_{144}$: K S E |
| $X_{145}$: A L | $X_{146}$: E D | $X_{147}$: Y N |
| $X_{148}$: V I | $X_{149}$: V I | $X_{150}$: A V I |
| $X_{151}$: G E | $X_{152}$: E P D | $X_{153}$: K S G |
| $X_{154}$: A Q | $X_{155}$: K T | $X_{156}$: L I |
| $X_{157}$: S H N | $X_{158}$: F Y | $X_{159}$: K R |
| $X_{160}$: K Q | $X_{161}$: A T S | $X_{162}$: A Y M |
| $X_{163}$: K R | $X_{164}$: E D | $X_{165}$: L V |
| $X_{166}$: L V | $X_{167}$: L F | $X_{168}$: L I |
| $X_{169}$: A M | $X_{170}$: L V | $X_{171}$: V I |
| $X_{172}$: A S | $X_{173}$: V I | $X_{174}$: T G |
| $X_{175}$: A T | $X_{176}$: - M | $X_{177}$: F - |
| $X_{178}$: G - | | |

Preferred amino acids for the each variable positions (as designated by the subscripted numbers in the sequence pattern) are set forth in Table 4. Desirably, such polypeptide has an immunogenic amino acid sequence wherein each of the above-identified variable positions is filled by one of the residues listed in Table 3 (or a single residue deletion, if applicable).

The invention also provides a recombinant truncated E polypeptide that induces an immune response against at least one dengue virus of each of at least two serotypes that is about equal to or greater than the immune response induced against the at least one dengue of each of the at least two serotypes by a combination of wild-type PRM15/truncated E polypeptides of the at least two serotypes, wherein each said wild-type PRM15/truncated E polypeptide is selected from SEQ ID NOS:149-152.

C15/Full Length prM/Full Length E Polypeptides

The invention also provides a recombinant or synthetic polypeptide comprising an amino acid sequence that has at least about 70%, 75%, 80%, 85%, 86%, 87%, 88%, 89%, 90%, 91%, 92%, 93%, 94%, 95%, 96%, 97%, 98%, 99% or more amino acid sequence identity to an amino acid sequence of at least one of SEQ ID NOS:139-148, 236-253, 343, and 345. In another aspect, a recombinant or synthetic polypeptide comprising an amino acid sequence that has at least about 70%, 75%, 80%, 85%, 86%, 87%, 88%, 89%, 90%, 91%, 92%, 93%, 94%, 95%, 96%, 97%, 98%, 99% or more amino acid sequence identity to an amino acid sequence of at least one of SEQ ID NOS:139-145, 147-148, 236-253, 343, and 345 is provided. Such polypeptides of the invention are typically termed C15/full length prM/full length E protein polypeptides (or simply "C15/full prM/full E" polypeptides").

Such C15/full length prM/full length E polypeptides induce an immune response in a subject, e.g., mammal against at least one dengue virus of at least one serotype selected from the group of dengue-1, dengue-2, dengue-3, and dengue-4. Further, some such polypeptides induce an immune response in a subject against at least one dengue virus of each of at least two, preferably at least three, and more preferably at least four serotypes selected from the group of dengue-1, dengue-2, dengue-3, and dengue-4. Preferably, the immune response induced against at least one dengue virus of the at least one serotypes is about equal to or greater than an immune response induced against the at least one dengue virus of the at least one serotype by a corresponding WT C15/full length prM/full length E fusion protein of the at least one serotype, wherein the WT C15/full length prM/full length E fusion protein of the same serotype for comparison is selected from SEQ ID NOS:227-230.

In one particular aspect, the immune response induced by the recombinant C15/full prM/full E polypeptide induced against at least one dengue virus of each of the four serotypes is about equal to or greater than that induced against that at least one dengue virus by any sequence selected from the group of SEQ ID NOS:227-230.

Such C15/full prM/full E polypeptides induce production of one or more antibodies that bind to at least one dengue virus of at least one serotype. Preferably, such polypeptides induces production of one or more antibodies that bind to at least one dengue virus of each of at least two, at least three, or preferably at least four dengue virus serotypes.

Such polypeptides induce the production of a number of antibodies that bind to at least one dengue virus of at least one serotype that is about equal to or greater than the number of antibodies that bind to the at least one dengue virus of the at least one serotype induced by a WT C15/full length prM/full length E fusion protein of the at least one dengue virus of the at least one serotype, wherein the WT C15/full length prM/full length E fusion protein of each particular serotype is selected for comparison from SEQ ID NOS:227-230.

In one aspect, a recombinant C15/full length prM/full length E polypeptide induces production of a number of antibodies that bind to at least one dengue virus of each of the at least two or at least three serotypes, wherein the number is about equal to or greater than the number of antibodies that bind to the at least one dengue virus of each of the at least two or at least three serotypes that are induced by a wild-type C15/full length prM/full length E polypeptide corresponding to each of the at least two or three serotypes selected from SEQ ID NOS:227-230, respectively. In one particular embodiment, a C15/full prM/full E polypeptide induces production of a number of antibodies that bind to at least one dengue virus of each of dengue-1, dengue-2, dengue-3, and dengue-4 that is about equal to or greater the number of antibodies that bind to the at least one dengue virus of each of those four serotypes that are induced by any one SEQ ID NOS:227-230, respectively.

Such recombinant wild-type C15/full length prM/full length E polypeptides induce the production of antibodies that bind more specifically to at least one particular dengue virus of at least one particular serotype than is induced by a corresponding wild-type C15/full length prM/full length E polypeptide from the dengue virus of the same one serotype, wherein the wild-type C15/full length prM/full length E polypeptide is selected from SEQ ID NOS:227-230.

Another characteristic of a recombinant C15/full length prM/full length E polypeptide of the invention is the ability to induce the production of a titer of neutralizing antibodies against at least one dengue virus of the at least one serotype. In one aspect, the polypeptide produces a titer of neutralizing antibodies against at least one dengue virus of each of at least two, at least three, or at least four serotypes. Some such polypeptides induce at least one neutralizing antibody response in a subject to or against at least one dengue virus of each of at least two, three or four serotypes without an occurrence of antibody-dependent enhancement (ADE) upon contact of the subject with the at least dengue virus of each of the at least two, three, or four serotypes, respectively.

Some such polypeptides produce a titer of neutralizing antibodies in a subject against at least one dengue virus of at least one serotype that is about equal to or greater than a titer of neutralizing antibodies produced in the subject against the at least one dengue virus of the at least one serotype by a WT C15/full length prM/full length E fusion protein of the at least one dengue virus of the at least one serotype. The WT C15/full length prM/full length E fusion protein can be selected from SEQ ID NOS:227-230. Further, some polypeptides produce a titer of neutralizing antibodies against at least one dengue virus of each of at least two, three, or four serotypes that is about equal to or greater than a titer of neutralizing antibodies produced against the at least one dengue virus of each of at least two, three, or four serotypes by a WT C15/full length prM/full length E fusion protein of the at least one dengue virus of each of the at least two, three, or four serotypes, respectively, wherein each WT C15/full length prM/full length E polypeptide is selected from SEQ ID NOS:227-230.

In one aspect, polypeptides having these immunogenic and immune-stimulating properties comprise an amino acid sequence that has at least about 95% amino acid sequence identity to the amino acid sequence of SEQ ID NO:140 or SEQ ID NO:141. In one particular aspect, such a polypeptide comprises SEQ ID NO:141.

Some such C15/full length prM/full length E polypeptides of the invention induce an immune response against at least one dengue virus of each of at least two serotypes that is about equal to or greater than the immune response induced against any of the at least one dengue virus of each of the at least two serotypes by a combination of WT C15/full length prM/full length E polypeptides of each of the at least two serotypes. WT C15/full length prM/full length E polypeptides can be selected from the group of SEQ ID NOS:227-230.

Recombinant C15/full length prM/full length E polypeptides exhibit additional biological properties that can be favorable for inducing, promoting, modulating, and/or enhancing an immune response, such as, e.g., the ability to form immunogenic viruses or virus-like particles in cells of a subject, including, e.g., mammalian cells. The invention provides a population of such recombinant polypeptides, wherein such polypeptides are capable of assembling with one another (and with other polypeptides and nucleic acids, as desired) to form one or more VLPs or viruses.

The invention also provides an antigenic or immunogenic fragment of any such polypeptide of the invention. The antigenic or immunogenic fragment of the polypeptide may comprise an amino acid sequence of about 10, about 20, about 30, or about 50 amino acids that comprises at least one T cell epitope not present in corresponding wild-type dengue virus C15, prM and E protein amino acid sequences, wherein the novel epitope is derived from one of the novel immunogenic amino acid sequences disclosed herein. Extension of the polypeptide by, e.g., inclusion of additional amino acid residue(s) and/or polypeptide or peptide segment (e.g., a signal peptide sequence or C-terminal E protein sequence, N-terminal prM protein sequence, or C15/N-terminal prM protein sequence) increases the length of the polypeptide. Common and preferable sizes for such polypeptides are further discussed elsewhere herein.

C Terminal E Protein Fragment Polypeptides

In one aspect of the invention, recombinant immunogenic or antigenic truncated E polypeptides, PRM15/truncated E polypeptides, and C15/full length prM/truncated E polypeptides of the invention may further comprise an additional amino acid sequence that is similar, substantially similar, or identical to an amino sequence segment or fragment (e.g., hydrophobic amino acid sequence) of the C-terminus transmembrane domain of a wild-type E protein of a flavivirus or a recombinant E protein of a flavivirus (such as, preferably, a dengue virus or yellow fever virus). Such amino acid sequence, which may be termed a C terminal amino acid fragment of a (flavivirus) E protein, C terminal E protein fragment (or simply "rest of envelope" or "rest of env" sequence), is typically about 20 to about 70 amino acid residues in length, more typically about 40 to about 65 amino acid residues in length, and often about 40 to about 65 amino acid residues in length. Such an amino acid fragment may comprise the amino acid sequence corresponding to the "stem-anchor region" of an E protein, which would typically anchor the remainder of the E protein (e.g., the truncated E protein portion) to the cell membrane when such E protein was incorporated into a virus.

Some such C terminal E protein fragments each comprise an amino acid sequence that has at least about 45%, desirably at least about 50% or 55% (e.g., about 60-99%), favorably at least about 60% or 65%, more favorably at least about 70% or 75%, advantageously at least about 80% or 85%, and preferably at least about 90%, 91%, 92%, 93%, 94%, 95%, 96%, 97%, 98%, or 99% or more amino acid sequence identity to at least one amino acid sequence of the group of SEQ ID NOS: 127-136.

Each such C terminal E protein fragment sequence is positioned near to (e.g., is within about 20 amino acids of) or fused to any of the following: 1) the C terminal amino acid of a recombinant truncated envelope (tE) protein polypeptide of the invention (e.g., SEQ ID NOS:1-49 and 154-155); 2) the C terminal amino acid of a recombinant PRM15/tE polypeptide of the invention (e.g., SEQ ID NOS:65-116); 3) the C terminal amino acid of a recombinant full length prM/tE fusion protein of the invention; or 4) the C terminal amino acid of a recombinant C15/full length prM/tE protein polypeptide of the invention as describe above. Such C terminal E protein fragment serves to extend the length of the truncated E polypeptide to a length that is about equal to or substantially equivalent to the length of a full length E polypeptide of a wildtype flavivirus, preferably a dengue virus of a particular serotype. Thus, a recombinant truncated E polypeptide, PRM15/truncated E polypeptide, and C15/full length prM/truncated E polypeptide of the invention that further comprises such a C terminal E polypeptide are typically referred to as a recombinant full length E polypeptide, PRM15/full length E polypeptide, and C15/full length prM/full length E polypeptide, respectively.

In one aspect, the amino acid sequence of such C terminal amino acid fragment of a (flavivirus) E protein comprises, or typically consists essentially of, an amino acid sequence according to the sequence pattern: Gly Val Ser Trp Xaa$_1$ Xaa$_2$ Xaa$_3$ Ile Xaa$_4$ Ile Gly Xaa$_5$ Xaa$_6$ Xaa$_7$ Xaa$_8$ Trp Xaa$_9$ Gly Xaa$_{10}$ Asn Ser Xaa$_{11}$ Xaa$_{12}$ Thr Ser Xaa$_{13}$ Xaa$_{14}$ Xaa$_{15}$ Xaa$_{16}$ Xaa$_{17}$ Xaa$_{18}$ Xaa$_{19}$ Xaa$_{20}$ Gly Xaa$_{21}$ Xaa$_{22}$ Thr Leu Xaa$_{23}$ Leu Gly Xaa$_{24}$ Xaa$_{25}$ Val Xaa$_{26}$ Ala, wherein Xaa represents any amino acid residue (see SEQ ID NO:137). Preferred amino acid residues for the variable positions in this sequence pattern are provided in Table 5.

TABLE 5

| | | |
|---|---|---|
| X$_1$: M I T | X$_2$: V M | X$_3$: K R |
| X$_4$: L G | X$_5$: V I F | X$_6$: I L |
| X$_7$: I L V | X$_8$: T L | X$_9$: I L |
| X$_{10}$: M L T | X$_{11}$: K R | X$_{12}$: S N |
| X$_{13}$: L M | X$_{14}$: S A | X$_{15}$: V M F |
| X$_{16}$: S T | X$_{17}$: L C | X$_{18}$: V I |
| X$_{19}$: L A | X$_{20}$: V I | X$_{21}$: V M I G |
| X$_{22}$: V I | X$_{23}$: Y F | X$_{24}$: A V F |
| X$_{25}$: M V T | X$_{26}$: Q H | |

Desirably, each one of the variable positions in this sequence pattern is filled by one of the preferred residues provided in Table 5.

The invention also includes polynucleotides encoding all such recombinant polypeptides as described herein and below. Such polypeptides and polypeptide-encoding nucleotides are useful in methods of the invention described throughout, including, e.g., but not limited to, prophylactic and/or therapeutic methods of treatment to induce, modulate, enhance, and/or promote an immune response(s) to at least one dengue virus of at least one flavivirus serotype in a mammal, and/or methods of detecting or diagnosing the presence of antibodies in a sample that bind to one or more dengue viruses of one or more serotypes.

N Terminal C15/Truncated prM Polypeptides

Recombinant PRM15/tE polypeptides and PRM15/full E polypeptides may further comprise an additional amino acid sequence that has at least about 50%, desirably at least about 60% (e.g., about 65% to about 100%), favorably at least about 70%, preferably at least about 80%, and more preferably at least about 90%, 91%, 92%, 93%, 94%, 95%, 96%, 97%, 98%, or 99% or more amino acid sequence identity to an amino acid sequence of at least one of the group of SEQ ID NOS:117-126. In one embodiment, such an amino acid sequence comprises at least the two following segments: (1) the last 15 amino acid residues of recombinant or wild-type capsid (C) protein of a flavivirus (e.g., preferably dengue virus), as measured in reverse sequence order from the C terminus of the capsid protein sequence and (2) all of the amino acid residues of a recombinant or wild-type prM protein of a flavivirus (e.g., preferably dengue virus), as measured in sequence order from the N terminus of the prM protein sequence, except the last 15 amino acid of the C terminus of the prM protein. Typically, segment (1) and segment (2) are attached or fused, and segment (1) precedes segment (2), positioned at the N terminus. Such an amino acid sequence is typically termed an N terminal amino acid fragment sequence of C15/prM or an N terminal C15/truncated prM polypeptide (or "rest of C15/PRM," since it includes 15 residues from the C protein and the remaining residues of the prM protein, but for the 15 C terminal residues). Such an N terminal C15/truncated prM polypeptide is usually at least about 150, 160, 165, 170, 175, or 180 amino acid residues in length. Some such polypeptide fragments are at least about 165 to about 175 amino acids in length. Some such polypeptide fragments are at least about 167 to about 171 amino acids in length.

An N terminal C15/truncated prM polypeptide is positioned near to or at (e.g., is within about 20 amino acids of), or is fused directly to, the N-terminus of the signal peptide sequence or immunogenic amino acid sequence (e.g., an immunogenic truncated E polypeptide sequence or an immunogenic full length E polypeptide sequence) of an immunogenic polypeptide of the invention, depending on the position (and presence) of the signal peptide sequence in the polypeptide. For example, in one format, an N terminal C15/truncated prM polypeptide is positioned near or at or is fused directly to the N terminus of a recombinant PRM15/tE dengue virus polypeptide of the invention (e.g., SEQ ID NOS:65-116) or the N terminus of a recombinant PRM15/full length E polypeptide of the invention (SEQ ID NOS:139-148, 236-253). In another aspect, the N terminal C15/truncated prM polypeptide is positioned near or at or is fused directly to the N terminus of a recombinant truncated E dengue virus polypeptide of the invention (e.g., SEQ ID NOS:1-49 and 153-155) or the N terminus of a recombinant full length E polypeptide of the invention.

In another aspect, a recombinant PRM15/tE polypeptide or PRM15/full E polypeptide further comprises an N terminal C15/truncated prM polypeptide positioned near to or at or fused directly to the N-terminus of the PRM15/tE polypeptide or PRM15/full E polypeptide, respectively, wherein the N terminal C15/truncated prM polypeptide comprises an amino acid sequence according to the sequence pattern set forth in SEQ ID NO:138, which comprises: Xaa$_1$ Xaa$_2$ Xaa$_3$ Xaa$_4$ Xaa$_5$ Xaa$_6$ Xaa$_7$ Xaa$_8$ Xaa$_9$ Xaa$_{10}$ Xaa$_{11}$ Pro Xaa$_{12}$ Xaa$_{13}$ Xaa$_{14}$ Ala Phe Xaa$_{15}$ Leu Xaa$_{16}$ Xaa$_{17}$ Arg Xaa$_{18}$ Gly Glu Pro Xaa$_{19}$ Xaa$_{20}$ Ile Val Xaa$_{21}$ Xaa$_{22}$ Xaa$_{23}$ Glu Xaa$_{24}$ Gly Xaa$_{25}$ Xaa$_{26}$ Leu Leu Phe Lys Thr Xaa$_{27}$ Xaa$_{28}$ Gly Xaa$_{29}$ Asn Xaa$_{30}$ Cys Thr Leu Xaa$_{31}$ Ala Xaa$_{32}$ Asp Leu Gly Glu Xaa$_{33}$ Cys Xaa$_{34}$ Asp Thr Xaa$_{35}$ Thr Tyr Lys Cys Pro Xaa$_{36}$ Xaa$_{37}$ Xaa$_{38}$ Xaa$_{39}$ Xaa$_{40}$ Glu Pro Xaa$_{41}$ Asp Xaa$_{42}$ Asp Cys Trp Cys Asn Xaa$_{43}$ Thr Xaa$_{44}$ Xaa$_{45}$ Trp Val Xaa$_{46}$ Tyr Gly Thr Cys Xaa$_{47}$ Xaa$_{48}$ Xaa$_{49}$ Gly Glu Xaa$_{50}$ Arg Arg Xaa$_{51}$ Lys Arg Ser Val Ala Leu Xaa$_{52}$ Pro His Xaa$_{53}$ Gly Xaa$_{54}$ Gly Leu Xaa$_{55}$ Thr Arg Xaa$_{56}$ Xaa$_{57}$ Thr Trp Met Ser Xaa$_{58}$ Glu Gly Ala Trp Xaa$_{59}$ Xaa$_{60}$ Xaa$_{61}$ Xaa$_{62}$ Xaa$_{63}$ Xaa$_{64}$ Glu Xaa$_{65}$ Trp Xaa$_{66}$ Leu Arg Xaa$_{67}$ Pro Xaa$_{68}$ Phe Xaa$_{69}$ Xaa$_{70}$ Xaa$_{71}$ Ala Xaa$_{72}$ Xaa$_{73}$ Xaa$_{74}$ Ala Xaa$_{75}$ Xaa$_{76}$ Ile Gly Xaa$_{77}$ Xaa$_{78}$ Xaa$_{79}$ Xaa$_{80}$ Gln Xaa$_{81}$, where Xaa represents any amino acid residue. Preferred amino acid residues for the variable (Xaa) positions for such a N terminal C15/truncated prM polypeptide sequence are provided in Table 6.

TABLE 6

| | | |
|---|---|---|
| X$_1$: M R | X$_2$: R K | X$_3$: S T |
| X$_4$: V S T A | X$_5$: T L G I | X$_6$: M C V T |
| X$_7$: I L | X$_8$: L M I | X$_9$: M C |
| X$_{10}$: L M | X$_{11}$: L I | X$_{12}$: T A |
| X$_{13}$: A T V | X$_{14}$: L M | X$_{15}$: H S |
| X$_{16}$: T S | X$_{17}$: T S | X$_{18}$: G D N |
| X$_{19}$: T L R H | X$_{20}$: L M | X$_{21}$: S A G |
| X$_{22}$: K R | X$_{23}$: Q H N | X$_{24}$: R K |
| X$_{25}$: K R | X$_{26}$: S P | X$_{27}$: S T A E |
| X$_{28}$: A E S D | X$_{29}$: V I | X$_{30}$: M K |
| X$_{31}$: I M | X$_{32}$: M I | X$_{33}$: L M |
| X$_{34}$: E D | X$_{35}$: M V I | X$_{36}$: R L H |
| X$_{37}$: M L I | X$_{38}$: T R V | X$_{39}$: E Q N |
| X$_{40}$: A N V T | X$_{41}$: D E | X$_{42}$: V I |
| X$_{43}$: A L S | X$_{44}$: D S | X$_{45}$: T A |
| X$_{46}$: T M | X$_{47}$: S N T | X$_{48}$: Q T |
| X$_{49}$: T A S | X$_{50}$: H R | X$_{51}$: D E |
| X$_{52}$: D A T V | X$_{53}$: V S | X$_{54}$: L M |
| X$_{55}$: E D | X$_{56}$: T A | X$_{57}$: E Q |
| X$_{58}$: S A | X$_{59}$: K R | X$_{60}$: H Q |
| X$_{61}$: I V A | X$_{62}$: Q E | X$_{63}$: K R |
| X$_{64}$: V I | X$_{65}$: T S | X$_{66}$: A I |
| X$_{67}$: H N | X$_{68}$: G R | X$_{69}$: T I A |
| X$_{70}$: V I L | X$_{71}$: I L M | X$_{72}$: L A G |

TABLE 6-continued

| $X_{73}$: F I | $X_{74}$: L M | $X_{75}$: H Y |
| $X_{76}$: A Y T M | $X_{77}$: T Q | $X_{78}$: T S |
| $X_{79}$: I L H G | $X_{80}$: T F I | $X_{81}$: K R |

Desirably, each one of the variable positions of the above-described sequence pattern is filled by one of the above-listed amino acid residues.

In some aspects, a recombinant PRM15/tE polypeptide of the invention (e.g., such as a polypeptide having at least about 85% identity to a polypeptide sequence selected from any of SEQ ID NOS 65-116) further comprises an N terminal C15/truncated prM polypeptide comprising a sequence selected from SEQ ID NOS:117-126 and/or a C terminal E protein fragment polypeptide comprising a sequence selected from SEQ ID NOS:127-136.

In other aspects, a polypeptide of the invention, such as, e.g., a recombinant truncated E polypeptide, PRM15/truncated E polypeptide, or C15/full prM/truncated E polypeptide, desirably comprises a C terminal E protein fragment comprising an amino acid sequence that has less than 100% sequence identity (e.g., about 99%, 98%, 97%, 96%, 95%, 94%, 90%) with a C terminal E protein fragment sequence of a wild-type dengue virus E protein of one of the four serotypes (e.g., SEQ ID NOS:127-130). A polypeptide of the invention, such as, e.g., a recombinant PRM15/truncated E polypeptide or PRM15/full E polypeptide also or alternatively can comprise an N terminal C15/truncated prM polypeptide that has less than 100% amino acid sequence identity (e.g., about 99%, 98%, 97%, 96%, 95%, 94%, 90%) with an N terminal C15/truncated prM polypeptide sequence of a wild-type dengue virus prM protein (e.g., SEQ ID NOS: 117-120).

In some aspects, a C15/full prM/full E polypeptide, which includes a C terminal E protein fragment that has less than 100% sequence identity with the sequence of a C terminal E protein of a WT dengue virus E protein and a C15/truncated prM polypeptide that has less than 100% sequence identity with the sequence of an N terminal C15/truncated prM polypeptide of a WT dengue virus, comprises a polypeptide sequence that has at least about 65%, at least about 70%, typically at least about 75% or at least about 80%, preferably at least about 85% (including e.g., at least about 85 to about 99.5%), and more preferably at least about 90%, at least about 91%, at least about 92%, at least about 93%, at least about 93%, at least about 94%, at least about 95%, at least about 96%, at least about 97%, at least about 98%, or at least about 99% or more amino acid sequence identity to at least one of SEQ ID NOS:139-148, 236-253, 343, and 345. More preferably, such a polypeptide comprises a polypeptide sequence selected from (or having at least about 80%, about 85%, about 88%, about 90%, about 95%, 97%, about 98%, or about 99% identity with) SEQ ID NOS:139-148, 236-253, 343, and 345. Polypeptides that have at least about 80%, more preferably at least about 85%, and even more preferably at least about 90% (e.g., about 90%, 92%, 93%, 94%, or 95%) identity with SEQ ID NO:140 or SEQ ID NO:141 are a particular aspect of this invention. Preferred polypeptides comprise (or at least have about 96%, about 97%, about 98%, about 99%, or more identity with) SEQ ID NO:141.

The invention also provides for the use of a novel C terminal E protein fragment polypeptide of the invention (e.g., SEQ ID NOS:131-136) and C15/truncated prM polypeptide of the invention (e.g., SEQ ID NOS:121-126) independently of the inclusion of either in any of the above-described polypeptides. For example, polypeptides comprising or consisting essentially of at least one such novel C terminal E protein fragment polypeptide and/or at least one such novel C15/truncated prM polypeptide can be used to induce or promote an immune response to a flavivirus, such as a dengue, virus in a mammalian host; can be used in methods of diagnosis or detecting the presence of antibodies that bind to one or more dengue viruses of a biological sample; and/or can be used in the formation of dengue virus immunogens or antigens. The use of the nucleic acid sequences encoding these C terminal E protein fragment polypeptides and C15/truncated prM polypeptides, alone or in combination with other nucleic acid sequences, including those encoding PRM/tE polypeptides of the invention, also is provided.

The inventors also contemplate the use of novel PRM15-homologs (also referred to as "prM15 homologs") of the invention (e.g., SEQ ID NOS:56-64), for example, in the formation of dengue virus immunogens or antigens, as signal peptide sequences for truncated dengue virus E protein antigens (e.g., such as SEQ ID NOS:1-49 and 153-155) or full length dengue virus E protein antigens), or as signal peptides for other viral polypeptides, such as flavivirus truncated E proteins or full length E proteins, or non-viral polypeptides. The use of the nucleic acid sequences encoding these signal peptides (e.g., portions of the polynucleotides described herein which code such amino acid sequences), alone or in combination with other nucleic acid sequences, such as, e.g., recombinant truncated E polypeptides of the invention, is also provided. In one aspect, e.g., the use of such a signal peptide nucleic acid sequence with an immunogenic nucleic acid (e.g., nucleic acid encoding any of SEQ-ID NOS:1-49 and 153-155) in a DNA vaccine is contemplated.

A immunogenic polypeptide comprising or consisting essentially of an amino acid sequence that is substantially identical (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) to an amino acid sequence selected from the group of SEQ ID NOS:1-49 and 153-155 is at least about 400 to about 500 amino acids in length (more typically at least about 440 to about 460 amino acids in length). The lower size limit for the immunogenic amino acid sequence, and, accordingly, the polypeptide itself, typically is only dictated by the desired use of the polypeptide. In aspects where the immunogenic polypeptide is used to promote an immune response to a dengue virus, the size of the polypeptide can be similar to that of at least a truncated dengue virus envelope protein (e.g., about 440 amino acids). Alternatively, the truncated E polypeptide can be extended to a full length E protein polypeptide (having an amino acid sequence about at least as long as a WT dengue virus E protein or WT flavivirus E protein) as described herein. Alternatively, in methods wherein the polypeptide is used to induce an immune response, the polypeptide comprises a PRM15/truncated E polypeptide (e.g., about 435-465 amino acids, or a C15 signal sequence/full length prM/full length E polypeptide (e.g., about 650-680 amino acids).

Viruses and Virus-Like Particles

The invention also provides recombinant or synthetic viruses and virus-like particles (VLPs) comprising one or more of the polypeptides, nucleic acids, or vectors of the invention. Such viruses and VLPs, which may be attenuated, are useful in methods of inducing, modulating, enhancing or promoting an immune response to at least one flavivirus, preferably dengue virus, of at least one serotype as described herein. Such viruses and VLPs are useful in therapeutic and/or prophylactic methods to treat flaviviral infection (e.g., infection by one or more dengue viruses) or protect against infection by a flavivirus (e.g., infection by one or more dengue viruses). Such viruses and VLPs are useful in vaccines to safeguard against dengue viral infection and/or ADE.

In one aspect, the invention provides a virus comprising (a) a nucleic acid comprising a nucleotide sequence that has at least about 90%, 95%, or 100% sequence identity to a nucleotide sequence selected from any of SEQ ID NOS:156-218, 235, 254-271, 285-330, 342, and 344,; and/or (b) a polypeptide comprising an amino acid sequence that has at least about 90%, 95%, or 100% sequence identity to a sequence selected from any of SEQ ID NOS:1-49, 65-116, 139-148, 153-155, 236-253, 343, and 345.

Also provided is a chimeric virus comprising: (a) a nucleic acid comprising a nucleotide sequence that has at least about 90, 95, or 100% sequence identity to a sequence selected from any of SEQ ID NOS:156-218, 235, 254-271, 285-330, 342, and 344, and at least one additional nucleic acid from a genome of another virus, including a flavivirus or adenovirus. The flavivirus may be a dengue virus (e.g., DEN-1, DEN-2, DEN-3, DEN-4) or yellow fever virus, Japanese encephalitis virus; Equine encephalitis virus; West Nile virus); and/or (b) a polypeptide comprising an amino acid sequence having at least about 90%, 95%, or 100% sequence identity to a sequence selected from any of SEQ ID NOS:1-49, 65-116, 139-148, 153-155, 236-253, 343, and 345 and at least one additional amino acid comprising a structural or non-structural polypeptide of a flavivirus or a fragment of a structural or non-structural polypeptide of a flavivirus, wherein said flavivirus is a dengue virus (e.g., DEN-1, DEN-2, DEN-3, or DEN-4) or is not a dengue virus (e.g., yellow fever virus, Japanese encephalitis virus; Equine encephalitis virus; or West Nile virus).

In another aspect, the invention provides a method of inducing an immune response in a host against a first flavivirus comprising: (a) providing a nucleic acid comprising a nucleotide sequence that has at least about 90%, 95%, or 100% sequence identity to a sequence selected from any of SEQ ID NOS:156-218, 235, 254-271, 285-330, 342, and 344, wherein said nucleic acid comprises a DNA sequence; (b) generating infectious RNA transcripts from the DNA sequence; (c) introducing the RNA transcripts into a cell; (d) expressing the RNA transcripts in the cell to produce virus; (e) harvesting the virus from said cell; and (g) inoculating the host with virus.

As used herein, the term "virus" includes not only complete virus particles, but also virus-like particles (VLPs) that include one or more polypeptides of the invention. A desirable feature of polypeptides comprising one of the above-described C15/full length prM/full length E polypeptides, and full length prM/truncated E polypeptides is the formation of virus-like particles (VLPs) in a mammalian host by a population of the polypeptides. VLPs lack the viral components that are required for virus replication and thus represent a highly attenuated form of a virus. A VLP of the invention can display a polypeptide (e.g., recombinant antigen) that is protective against one or more flavivirus serotypes, preferably one or more dengue virus serotypes. VLPs can display more than one type of polypeptide (e.g., recombinant antigen); e.g., a VLP can display and thus are useful as a polyvalent vaccine where antigens that are protective. In some embodiments, the methods of the invention are used to obtain VLPs that have desired characteristics or properties as described herein, including e.g., those relating to enhanced cross-protection against and/or cross-reactivity with at least two flavivirus serotypes (preferably at least two dengue virus serotypes), secretion, and/or expression. Viral proteins from several viruses are known to form VLPs, including human papillomavirus, HIV (Kang et al., *Biol. Chem*. 380: 353-64 (1999)), Semliki-Forest virus (Notka et al., *Biol. Chem*. 380: 341-52 (1999)), human polyomavirus (Goldmann et al., *J Virol*. 73: 4465-9 (1999)), rotavirus (Jiang et al., *Vaccine* 17: 1005-13 (1999)), parvovirus (Casal, *Biotechnology and Applied Biochemistry*, Vol 29, Part 2, pp 141-150 (1999)), canine parvovirus (Hurtado et al., *J. Virol*. 70: 5422-9 (1996)), and hepatitis E virus (Li et al., *J Virol*. 71: 7207-13 (1997)).

The formation of such VLPs can be detected by any suitable technique. Examples of suitable techniques known in the art for detection of VLPs in a medium include, e.g., electron microscopy techniques, dynamic light scattering (DLS), selective chromatographic separation (e.g., ion exchange, hydrophobic interaction, and/or size exclusion chromatographic separation of the VLPs) and density gradient centrifugation.

In another aspect, the invention also provides modified, mutant, synthetic or recombinant dengue viruses. Accordingly, the invention provides a modified (e.g., mutant, synthetic, or recombinant) dengue virus that comprises at least one recombinant dengue virus nucleic acid or polypeptide of the invention described herein. In one embodiment, the invention provides a modified or recombinant dengue virus produced by expression or translation of a recombinant nucleic acid of the invention in a population of a subject's cells, e.g., mammalian cells, including, e.g., mouse, primate, and/or human cells. In another embodiment, the invention provides a modified or recombinant dengue virus that comprises at least one recombinant DNA nucleotide sequence of the invention described herein. In yet another embodiment, the invention provides a modified or recombinant dengue virus produced by expression or translation of an RNA nucleic acid in a population of cells, e.g., mammalian cells, the RNA nucleic acid comprising an RNA nucleic acid sequence that comprises a modified or recombinant DNA nucleic acid sequence of the invention, wherein each thymine residue of such DNA nucleic acid sequence is replaced by a uracil residue; the invention also includes a complementary sequence of each said RNA nucleic acid sequence. In another preferred embodiment, the invention provides a modified or recombinant dengue virus comprising an RNA nucleotide sequence, said RNA nucleotide sequence comprising the isolated or recombinant DNA nucleic acid sequence of any of SEQ ID NOS:156-218, 235, 254-271, 285-330, 342, and 344, wherein each thymine residue in each said DNA nucleotide sequence is replaced by a uracil residue; an RNA sequence that is complementary to each said RNA nucleotide sequence is also provided.

Properties and Characteristics

Recombinant, synthetic, mutant, and/or isolated polypeptides of the invention exhibit a variety of properties and characteristics and are useful in a variety of contexts. In one aspect, such polypeptides are useful in methods of detecting or diagnosing of anti-flaviviral antibodies, especially anti-dengue virus antibodies in a biological sample, as described in greater detail below. In another aspect, a characteristic of the recombinant, synthetic, and/or isolated polypeptides of the invention is the promotion of an immune response to at least a portion of a dengue virus (e.g., a dengue virus antigen, a collection of dengue virus antigens, a fragment of a dengue virus, a dengue virus VLP, or an inactivated, attenuated, or virulent dengue virus of one, two, three, or even four serotypes) in an animal or population of animal cells, and preferably in a mammal, even more preferably in a human. "Promotion" encompasses any detectable increase, including induction of an immune response and increase of an already existing immune response. The polypeptides of the invention can induce a cytotoxic (or other T-cell) immune response, a humoral (antibody-mediated) immune response, or (most desirably) both, in such a host. The polypeptide can promote the production of an antibody that binds to at least a portion of a dengue virus (e.g., a particular dengue virus antigen), in a subject, such as a mammal. Desirably, the polypeptide promotes an anamnestic antibody response to a dengue virus (which can be determined by known IgG/IgM kinetics analysis techniques), and the polypeptide induces or promotes a "solid" (anamnestic and non-viremic) antibody response to a dengue virus.

More particular characteristics of immune responses attendant the administration or expression of one or more polypeptides of the invention to a subject host, such as a mammal, include the priming and stimulation of CD4+ and CD8+ lymphocytes, particularly CD8+ lymphocytes, the promotion of host cell production of anti-dengue virus IgM and/or IgG antibodies, T cell activation and cytokine release (including, but not limited to, e.g., release of one or more tumor necrosis factors (TNF) (e.g., TNF-alpha), the production of one or more interleukins (IL) (e.g., IL-1, IL-2, IL-3, IL-4, IL-5, IL-6, IL-10, IL-12), the production of one or more interferons (IFN) (e.g., IFN-gamma, IFN-alpha, IFN-beta), TGF from T cells), complement activation, platelet activation, enhanced and/or decreased Th1 responses, enhanced and/or decreased Th2 responses, and humoral immunological memory.

An important characteristic of polypeptides of the invention is the promotion of an immune response to at least one dengue virus of one or more, preferably multiple, serotypes in a subject. For example, the invention provides polypeptides comprising an immunogenic amino acid sequence that induces production of one or more antibodies that bind at least one dengue virus of each of at least two virus serotypes in animals, such as a mammal.

More preferred polypeptides of the invention promote an immune response to one or more dengue virus variants of each of at least three virus serotypes of in an animal, e.g., a mammal. For example, a particular polypeptide of the invention can promote the production of one or more antibodies that bind at least one dengue virus of each of at least three virus serotypes in a mammal when an antigenic or immunogenic quantity of such a polypeptide is expressed in, administered to, or delivered to the mammal.

An advantage of polypeptides of the invention is the ability to induce an immune response to at least a portion (preferably to multiple portions—e.g., multiple epitopes) of at least one dengue virus of at least one serotype in vivo and ex vivo (in contrast to polypeptides that only induce such an immune response in cell culture). Some polypeptides of the invention induce production of one or more antibodies (an antibody response) to antigens (including dengue virus Ags) of all four known dengue virus serotypes in a subject (e.g., including, but not limited to SEQ ID NOS:2, 3, 5, 25, 29, 66, 67, 69, 89, 93, 44-46, 108-110, 140, and 141).

An advantage of PRM15/tE polypeptides of the invention is the ability to induce or promote an immune response to one or more dengue viruses of one or more serotypes that is about equal to or even greater than the immune response induced or promoted against such one or dengue viruses of one or more serotypes, respectively, by a PRM15/tE polypeptide comprising a wild-type dengue virus PRM15/tE polypeptide (e.g., SEQ ID NOS:149-152). Preferably, the PRM15/tE polypeptide is capable of inducing or promoting an immune response against at least one dengue virus of at least one serotype that is at least equal to or greater than that induced or promoted against the at least one dengue virus of the at least one serotype by a wild-type dengue virus PRM15/tE antigenic polypeptide of any virus serotype (e.g., more than any of SEQ ID NOS:149-152). Preferably, the polypeptide of the invention induces an immune response in a subject to at least one dengue virus of at least two, more preferably at least three, even more preferably at least four, virus serotypes, in a mammalian cell that is equal to or greater than the immune response induced against said at least one dengue virus of at least two, at least three, at least four virus serotypes in a subject by wild-type dengue virus PRM15/tE polypeptide of the respective serotype.

Moreover, some such PRM15/tE polypeptides also or alternatively can induce or promote an immune response in vivo or ex vivo against at least one dengue virus of all four serotypes in a subject that is at least about equal to or greater than the immune response induced or promoted against at least one dengue virus of all four serotypes by the combination of wild-type dengue virus PRM15/tE antigenic polypeptides of all four serotypes (e.g., equal to or greater than the combination of SEQ ID NOS:149-152).

An advantage of C15/full prM/full E polypeptides of the invention is the ability to induce or promote an immune response to at least one dengue virus of at least one serotype that is about equal to or even greater than the immune response induced or promoted against at least one dengue virus of the at least one serotype by a wild-type dengue virus C15/full prM/full E polypeptide (e.g., SEQ ID NOS:227-230). Preferably, a C15/full prM/full E polypeptide induces an immune response in a subject to at least one dengue virus of at least two, more preferably at least three, even more preferably at least four, virus serotypes, in a subject that is equal to or greater than the immune response induced serotypes in the subject against said at least one dengue virus of at least two, at least three, at least four virus cell by wild-type dengue virus C15/full prM/full E polypeptide of the respective serotype.

In one aspect, a C15/full prM/full E is capable of inducing or promoting an immune response against at least one dengue virus of at least one serotype that is greater than that induced or promoted against the respective dengue virus serotype(s) by a C15/full prM/full E antigenic polypeptide of any serotype (e.g., >than any of SEQ ID NOS:227-230).

Moreover, some such C15/full prM/full E PRM15/tE polypeptides also or alternatively induce or promote an immune response against at least one dengue virus of at least one serotype in vivo in a subject or ex vivo in a population of cells of a subject that is at least about equal to or greater than the immune response against the at least one dengue virus of at least one serotype induced or promoted by the combination of C15/full prM/full E antigenic polypeptides of all four dengue virus serotypes (e.g., equal to or greater than the combination of SEQ ID NOS:227-230).

Some C15/full prM/full E polypeptides of the invention which form VLPs induce an immune response in a subject against at least one dengue virus of at least one serotype that is about equal to or greater than that induced against the at least one dengue virus of the at least one serotype by an incomplete wild-type dengue virus truncated capsid/full prM/full E VLP (e.g., a VLP formed from wild-type dengue virus C15/full prM/full E polypeptides), an inactivated dengue virus particle, or both. Select C15/full prM/full E polypeptides also may be able to induce an immune response to at least one dengue virus of at least one serotype a dengue virus that is at least equal to or greater than the immune response induced to at least one dengue virus of at least one serotype by an attenuated WT dengue virus in a subject.

Especially advantageous are truncated E polypeptides, PRM15/tE polypeptides, or C15/full prM/full E polypeptides of the invention that promote an immune response to at least one dengue virus of all four known serotypes that is about equal to or greater than the immune response promoted by one of the corresponding wild-type dengue virus truncated E polypeptide, PRM15/tE polypeptide (e.g., SEQ ID NOS:149-152), or C15/full prM/full E polypeptide (e.g., SEQ ID NOS: 227-230) of the same serotype or a combination of such wild-type polypeptides of all four serotypes. The invention further provides a PRM15/tE polypeptide that promotes a greater immune response to one or more dengue viruses of all four serotypes than is induced by a wild-type dengue virus PRM15/tE of any serotype (e.g., induces a greater immune response than that induced by a polypeptide consisting essentially of any of SEQ ID NOS:149-152) or combination thereof. The invention also provides a C15/full prM/full E polypeptide that promotes a greater immune response to one or more dengue viruses of all four serotypes than is induced by a wild-type dengue virus C15/full prM/full E of any serotype (e.g., induces a greater immune response than that induced by a polypeptide consisting essentially of any of SEQ ID NOS:227-330) or combination thereof.

Immune responses generated or induced by the polypeptides of the invention can be measured by any suitable technique. Examples of useful techniques in assessing humoral immune responses include flow cytometry, immunoblotting (detecting membrane-bound proteins), including dot blotting, immunohistochemistry (cell or tissue staining), enzyme immunoassays, immunoprecipitation, immunohistochemistry, RIA (radioimmunoassay), and other EIAs (enzyme immunoassays), such as ELISA (enzyme-linked immunosorbent assay—including sandwich ELISA and competitive ELISA) and ELIFA (enzyme-linked immunoflow assay). ELISA assays involve the reaction of a specific first antibody with an antigen. The resulting first antibody-antigen complex is detected by using a second antibody against the first antibody; the second antibody is enzyme-labeled and an enzyme-mediated color reaction is produced by reaction with the first antibody. Suitable antibody labels for such assays include radioisotopes; enzymes, such as horseradish peroxidase (HRP) and alkaline phosphatase (AP); biotin; and fluorescent dyes, such as fluorescein or rhodamine. Both direct and indirect immunoassays can be used in this respect. HPLC and capillary electrophoresis (CE) also can be utilized in immunoassays to detect complexes of antibodies and target substances. General guidance performing such techniques and related principles are described in, e.g., Harlow and Lane (1988) ANTIBODIES, A LABORATORY MANUAL, Cold Spring Harbor Publications, New York, Hampton R et al. (1990) SEROLOGICAL METHODS A LABORATORY MANUAL, APS Press, St. Paul Minn., Stevens (1995) CLINICAL IMMUNOLOGY AND SEROLOGY: A LABORATORY PERSPECTIVE, CRC press, Bjerrum (1988) HANDBOOK OF IMMUNOBLOTTING OF PROTEINS, Vol. 2, Zoa (1995) DIAGNOSTIC IMMUNOPATHOLOGY: LABORATORY PRACTICE AND CLINICAL APPLICATION, Cambridge University Press, Folds (1998) CLINICAL DIAGNOSTIC IMMUNOLOGY: PROTOCOLS IN QUALITY ASSURANCE AND STANDARDIZATION, Blackwell Science Inc., Bryant (1992) LABORATORY IMMUNOLOGY & SEROLOGY 3rd edition, W B Saunders Co., and Maddox D E et al. (1983) *J. Exp. Med*. 158: 1211. Specific guidance with respect to ELISA techniques and related principles are described in, e.g., Reen (1994) *Methods Mol Biol*. 32:461-6, Goldberg et al. (1993) *Curr Opin Immunol* 5(2):278-81, Voller et al. (1982) *Lab Res Methods Biol Med* 5:59-81, Yolken et al. (1983) *Ann N Y Acad Sci* 420:381-90, Vaughn et al. (1999) *Am J Trop Med Hyg* 60(4):693-8, and Kuno et al. *J Virol Methods (*1991) 33(1-2): 101-13. Guidance with respect to Western blot techniques can found in, e.g., Ausubel et al., CURRENT PROTOCOLS IN MOLECULAR BIOLOGY (Wiley Interscience Publishers 1995). Specific exemplary applications of Western blot techniques can be found in, e.g., Churdboonchart et al. (1990) *Southeast Asian J Trop Med Public Health* 21(4):614-20 and Dennis-Sykes et al. (1985) *J Biol Stand* 13(4):309-14. Specific guidance with respect to flow cytometry techniques is provided in, e.g., Diamond (2000) IN LIVING COLOR: PROTOCOLS IN FLOW CYTOMETRY AND CELL SORTING, Springer Verlag, Jaroszeki (1998) FLOW CYTOMETRY PROTOCOLS, 1st Ed., Shapiro (1995) PRACTICAL FLOW CYTOMETRY, 3rd edition, Rieseberg et al. (2001) *Appl Microbiol Biotechnol* 56(3-4):350-60, Scheffold and Kern (2000) *J Clin Immunol* 20(6):400-7, and McSharry (1994) *Clin Microbiol Rev* (4):576-604.

Briefly, a Western blot assay may be performed by attaching a recombinant dengue antigen, such as a recombinant polypeptide of the invention, to a nitrocellulose paper and staining with an antibody which has a dye attached. Among the methods using a reporter enzyme is the use of a reporter-labeled antihuman antibody. The label may be an enzyme, thus providing an enzyme-linked immunosorbent assay (ELISA). It also may be a radioactive element, thus providing a radioimmunoassay (RIA).

Cytotoxic and other T cell immune responses also can be measured by any suitable technique. Examples of such techniques include ELISpot assay (particularly, IFN-gamma ELISpot), intracellular cytokine staining (ICC) (particularly in combination with FACS analysis), CD8+ T cell tetramer staining/FACS, standard and modified T cell proliferation assays, chromium release CTL assay, limiting dilution analysis (LDA), and CTL killing assays. Guidance and principles related to T cell proliferation assays are described in, e.g., Plebanski and Burtles (1994) *J Immunol Meth* 170:15, Sprent et al. (2000) *Philos Trans R Soc Lond B Biol Sci* 355(1395): 317-22, and Messele et al. (2000) *Clin Diagn Lab Immunol* 7(4):687-92. LDA is described in, e.g., Sharrock et al. (1990) *Immunol Today* 11:281-286. ELISpot assays and related principles are described in, e.g., Czerinsky et al. (1988) *J Immunol Meth* 110:29-36, Olsson et al. (1990) *J Clin. Invest* 86:981-985, Schmittel et al. (2001) *J Immunol Meth* 247(1-2):17-24, Ogg and McMichael (1999) *Immunol Lett* 66(1-3):77-80, Schmittel et al. (2001) *J Immunol Meth* 247(1-2):17-24, Kurane et al. (1989) *J Exp Med* 170(3):763-75, Chain et al. (1987) J Immunol Meth 99(2):221-8, and Czerkinsky et al. (1988) *J Immunol Meth*, 110:29-36, as well as U.S. Pat. Nos. 5,750,356 and 6,218,132. Tetramer assays are discussed in, e.g., Skinner et al. (2000) *J Immunol* 165(2):613-7. Other T cell analytical techniques are described in Hartel et al. (1999) *Scand J Immunol* 49(6):649-54 and Parish et al. (1983) *J Immunol Meth* 58(1-2):225-37.

T cell activation also can be analyzed by measuring CTL activity or expression of activation antigens such as IL-2 receptor, CD69 or HLA-DR molecules. Proliferation of purified T cells can be measured in a mixed lymphocyte culture (MLC) assay. MLC assays are known in the art. Briefly, a mixed lymphocyte reaction (MLR) is performed using irradiated PBMC as stimulator cells and allogeneic PBMC as responders. Stimulator cells are irradiated (2500 rads) and co-cultured with allogeneic PBMC ($1\times10^5$ cells/well) in 96-well flat-bottomed microtiter culture plates (VWR) at 1:1 ratio for a total of 5 days. During the last 8 hours of the culture period, the cells were pulsed with 1 uCi/well of $^3$H-thymidine, and the cells are harvested for counting onto filter paper by a cell harvester as described above. ³H-thymidine incorporation is measured by standard techniques. Proliferation of T cells in such assays is expressed as the mean cpm read for the tested wells.

ELISpot assays measure the number of T-cells secreting a specific cytokine, such as interferon-gamma or tumor necrosis factor-alpha, that serves as a marker of T-cell effectors. Cytokine-specific ELISA kits are commercially available (e.g., an IFN-gamma-specific ELISpot is available through R&D Systems, Minneapolis, Minn.). ELISpot assays are further described in the Examples section (these and other assays are described in, e.g., Examples 23-26).

Where a particular recombinant polypeptide of the invention (e.g., recombinant truncated E polypeptide, full E polypeptide, PRM15/tE polypeptide, full prM/full E polypeptide, full prM/tE polypeptide, or C15/full prM/full E polypeptide) induces an approximately equal or greater immune response to a dengue virus of a particular serotype than does a corresponding wild-type dengue virus (e.g., truncated E polypeptide, full E polypeptide, PRM15/tE polypeptide, full prM/full E polypeptide, full prM/tE polypeptide, or C15/full prM/full E polypeptide, respectively), such approximately equal or greater immune response is typically an approximately equal or greater humoral immune response. That is, e.g., at least an equal or higher titer of neutralizing antibodies to the virus serotype is produced in response to the recombinant polypeptide than is produced by a corresponding wild-type dengue virus polypeptide (e.g., a wild-type dengue virus truncated E, full E, PRM15/tE, full prM/full E, full prM/tE, or C15/full prM/full E polypeptide). The particular recombinant truncated E, full E, PRM15/tE polypeptide, full prM/full E, full prM/tE, C15/full prM/full E polypeptide of the invention desirably induces a T cell response in mammalian cells or a mammal that is substantially similar to (e.g., is at least about 80%, at least about 85%, at least about 90%, at least about 95%, or about 100% effective as) the T cell response attendant the administration or expression of the corresponding wild-type dengue virus truncated E, full E, PRM15/tE, full prM/full E, full prM/tE, or C15/full prM/full E polypeptide in the mammalian cells or mammal.

Alternatively, where a T cell response is desired, the recombinant truncated E polypeptide or full E polypeptide, PRM15/tE polypeptide, or C15/full prM/full E polypeptide can be administered or expressed with one or more corresponding wild-type dengue virus truncated E or full E polypeptide, PRM15/tE polypeptide, or C15/full prM/full E polypeptide dengue prM, E, and/or fragments thereof, respectively (e.g., amino acid sequences comprising known T cell epitopes of such polypeptides), in the mammal. To retain a T cell response, the recombinant polypeptide desirably comprises one or more polypeptide fragments of the capsid protein, prM protein, and E protein of wild-type DEN-1, DEN-2, DEN-3, and/or DEN-4 of at least about 8 amino acids in length, and typically about 8 to about 25 amino acids (e.g., about 10 to about 20 amino acids) in length, wherein such one or more polypeptide fragments include a T cell epitope of a wild-type dengue virus C protein, prM protein, or E protein. In one preferred aspect, a recombinant PRM15/tE polypeptide comprises T cell epitope sequences, or variants or mutants of such T cell epitope sequences, that are observed in wild-type dengue virus PRM15 peptides and/or E proteins of two or more (e.g., multiple) serotypes, and preferably three or four serotypes. In one preferred aspect, a recombinant C15/full prM/full E polypeptide comprises T cell epitope sequences, or variants or mutants of such T cell epitope sequences, that are observed in wild-type dengue virus C15 peptides, prM proteins, and/or E proteins of two or more (e.g., multiple) serotypes, and preferably three or four serotypes.

A preferred characteristic of a recombinant polypeptide of the invention (including, e.g., a tE or full E polypeptide, PRM15/tE polypeptide, or C15/full prM/full E polypeptide) is the ability to induce a neutralizing antibody response against a dengue virus in a subject. A neutralizing antibody response can be determined, e.g., by a plaque reduction neutralization titer (PRNT) assay. Any suitable PRNT assay can be used to determine whether a polypeptide (or polynucleotide expressing such a polypeptide) induces one or more neutralizing antibodies against one or more dengue viruses of one or more serotypes. An exemplary plaque reduction neutralization titer assay for dengue viruses is described in Russell et al., *J Immunol* (1967) 99:285-290, which is incorporated herein by reference in its entirety for all purposes. Other PRNT methods and formats are well known to those of ordinary skill in the art. The results of such an assay depend on the selected level of neutralization desired. A $PRNT_{50}$, for example, is the highest serum dilution tested that reduces the number of plaque forming units (p.f.u.) by at least 50%. Typically, inverse PRNT scores are reported (see the Examples section below for further details on performing and analyzing the results of such assays). Favorably, as shown herein, select recombinant polypeptides of the invention (and polynucleotides of the invention expressing such polypeptides) are capable of inducing a neutralizing antibody response against dengue viruses of at least one or at least two serotypes in a subject. Advantageously, select recombinant polypeptides of the invention (and polynucleotides of the invention expressing such polypeptides) induce a neutralizing antibody response against one or more dengue viruses of each of at least three serotypes. As shown herein, some such recombinant polypeptides of the invention induce a neutralizing antibody response against one or more dengue viruses of each of the four known wild-type dengue virus serotypes in the subject, such as a mammal.

In addition to inducing a neutralizing antibody response, a recombinant PRM15/tE polypeptide of the invention also advantageously induces the production of an equal or higher titer of neutralizing antibodies against at least one dengue virus of at least one serotype than is induced against the at least one dengue virus of the at least one serotype by at least one wild-type dengue virus PRM15/tE polypeptide of the corresponding serotype (e.g., at least one of SEQ ID NOS: 149-152). Such polypeptides also or alternatively induce a higher titer of neutralizing antibodies against at least one dengue virus of at least one serotype than is induced against at least one dengue virus of at least one serotype by a combination of wild-type dengue virus PRM15/tE polypeptides of all four known serotypes (e.g., a higher titer of neutralizing antibodies than a combination of four polypeptides separately consisting essentially of SEQ ID NOS:149-152). In one aspect, the invention provides a PRM15/tE polypeptide that induces a higher titer of neutralizing antibodies against at least one dengue virus of each of the four serotypes in a subject than is induced by a WT dengue virus PRM15/tE polypeptide of any virus serotype (e.g., a higher titer than a polypeptide consisting essentially of any one of SEQ ID NOS:149-152).

The invention also provides PRM15/tE polypeptides that are capable of inducing an equal or higher titer of neutralizing antibodies against at least one dengue virus of each of at least two virus serotypes, preferably at least three virus serotypes, more preferably at least four virus serotypes, than can be induced antibodies against at least one dengue virus of each of at least two virus serotypes, preferably at least three virus serotypes, more preferably at least four virus serotypes by a WT dengue virus PRM15/tE polypeptide of each of at least two, at least three, or at least four known serotypes (e.g., at least two, three, or four of SEQ ID NOS:149-152 or a polypeptide consisting essentially of one of SEQ ID NOS: 149-152).

In another aspect, in addition to inducing a neutralizing antibody response, a recombinant C15/full prM/full E polypeptide of the invention also advantageously induces the production of an equal or higher titer of neutralizing antibodies against at least one dengue virus of at least one serotype than is induced against the at least one dengue virus of the at least one serotype by at least one wild-type dengue virus C15/full prM/full E polypeptide of the corresponding serotype (e.g., at least one of SEQ ID NOS:227-230). Such C15/full prM/full E polypeptides also or alternatively induce a higher titer of neutralizing antibodies against at least one dengue virus of at least one serotype than is induced against at least one dengue virus of at least one serotype by a combination of wild-type dengue virus C15/full prM/full E polypeptides of all four known serotypes (e.g., a higher titer of neutralizing antibodies than a combination of four polypeptides separately consisting essentially of SEQ ID NOS:227-230). In one aspect, the invention provides a C15/full prM/full E polypeptide that induces a higher titer of neutralizing antibodies against at least one dengue virus of each of the four serotypes in a subject than is induced by a WT dengue virus C15/full prM/full E polypeptide of any virus serotype (e.g., a higher titer than a polypeptide consisting essentially of any one of SEQ ID NOS:227-230).

The invention also provides recombinant C15/full prM/full E polypeptides that are capable of inducing an equal or higher titer of neutralizing antibodies against at least one dengue virus of each of at least two virus serotypes, preferably at least three virus serotypes, more preferably at least four virus serotypes, than can be induced antibodies against at least one dengue virus of each of at least two virus serotypes, preferably at least three virus serotypes, more preferably at least four virus serotypes by a wild-type dengue virus C15/full prM/full E polypeptide of each of at least two, at least three, or at least four known serotypes (e.g., at least two, three, or four of SEQ ID NOS:227-230 or a polypeptide consisting essentially of one of SEQ ID NOS:227-230).

A particularly advantageous feature attendant polypeptides of the invention is the ability to induce a neutralizing antibody response to dengue viruses of all four known virus serotypes in a subject. An exceptionally beneficial attribute of PRM15tE and C15/full prM/full E polypeptides of the invention is the ability to induce a higher level of neutralizing antibodies in a subject against one or more dengue viruses of all four serotypes than the level of neutralizing antibodies induced against such one or more dengue viruses of all four serotypes by a corresponding wild-type dengue virus polypeptide (e.g., wild-type PRM15/tE or wild-type C15/full prM/full E polypeptide) of all four serotypes (e.g., SEQ ID NOS:19-152 and 227-330, respectively), or combination of such wild-type polypeptides.

A particularly desirable characteristic of recombinant polypeptides of the invention is the ability to induce a neutralizing antibody response to at least one dengue virus, more preferably to at least two dengue viruses of multiple serotypes, and most preferably to dengue viruses of all four virus serotypes, in an animal, including a vertebrate, such as, e.g., a mammal. Thus, for example, serum taken from an animal (e.g., mammal) to which an immunogenic or antigenic amount of a recombinant polypeptide of the invention was administered (or to which an amount of a recombinant polynucleotide of the invention was administered sufficient to express an immunogenic or antigenic amount of the recombinant polypeptide) or in which an immunogenic or antigenic amount of a polypeptide of the invention was expressed, diluted at least about 30 fold, preferably at least about 40 fold or at least about 50 fold, and more preferably at least about 60 fold (e.g., at least about 70 fold, 80 fold, or higher), exhibits a neutralizing antibody response against about 50% of the dengue viruses in a sample of dengue viruses of at least three virus serotypes subjected to a plaque reduction neutralization titer assay.

An "antigenic amount" is an amount of an antigen, e.g., a polypeptide antigen or polynucleotide encoding such polypeptide antigen, that is sufficient to induce, promote, enhance, or modulate an immune response or immune reaction in cells in vitro, and/or in vivo in a subject or ex vivo in a subject's cells or tissues. An antigenic amount of a polypeptide may be produced by, e.g., administration or delivery of an antigenic amount of the polypeptide itself, or by administration or delivery of a polynucleotide that encodes an antigenic amount of such polypeptide.

In another aspect, a recombinant polypeptide of the invention induces a neutralizing antibody response to at least one dengue virus of all four dengue virus serotypes in a mammal to which such recombinant polypeptide (or polynucleotide encoding such recombinant polypeptide) is administered without an occurrence of antibody-dependent enhancement (ADE) upon infection of the mammal with the dengue virus. More particularly, the invention provides recombinant polypeptides, wherein serum obtained from an animal (e.g., mammal) to which had been administered an antigenic or immunogenic amount of at least one such recombinant polypeptide, or at least one recombinant nucleic acid or vector that encodes and/or expresses such an antigenic or immunogenic amount of such recombinant polypeptide of the invention, diluted at least about 40 fold, about 50 fold, or about 60 fold, and preferably at least about 70 fold or about 80 fold or more, neutralizes at least about 30%, at least about 40%, %, at least about 45%, at least about 50%, at least about 55%, at least about 60%, or more of a sample comprising at least one dengue virus of one or more of the four virus serotypes in a plaque reduction neutralization titer assay.

In one aspect, the invention provides recombinant polypeptides that exhibit a reciprocal $PRNT_{50}$ score of at least about 40, about 50, about 60, or about 70 or higher (e.g., about 40 to about 100, about 40 to about 80, about 60 to about 80, or about 70 to about 100) against one or more dengue viruses of each of two or more and preferably each of all four dengue virus serotypes. In one preferred aspect, the serum from a subject comprising such a level of polypeptide (either through expression or administration), diluted at least about 20fold, 40 fold, 60 fold, 70 fold or 80 fold, neutralizes at least about 50% of a sample of at least one flavivirus in a plaque reduction neutralization titer (PRNT) assay; in one aspect, one of such dilutions neutralizes at least about 50% of a sample of a dengue virus of each of the four virus serotypes in a PRNT assay.

In one aspect of the invention, polypeptides of the invention that induce a neutralizing antibody response to at least one dengue virus of all four virus serotypes desirably do so without exhibiting a disproportionate level of neutralizing antibody response to dengue viruses of one serotype such that the immune response or protection against one or more dengue viruses of other serotypes is compromised (i.e., masked by immunodominance). In this respect, reciprocal $PRNT_{50}$ scores against one or more dengue viruses of each of all four serotypes for sera obtained from a subject comprising an antigenic amount of at least one recombinant polypeptide of the invention may desirably be within a range such that the highest reciprocal $PRNT_{50}$ score is less than about 4×the lowest reciprocal $PRNT_{50}$ score (e.g., less than about 3.9×, about 3.8×, about 3.5×, about 3.4×, or about 3.3× the lowest score), less than about 3× the lowest reciprocal $PRNT_{50}$ (e.g., less than about 2.9×, about 2.8×, 2.5× about 2.4×, or about 2.3× the lowest score), and preferably less than about 2× the lowest reciprocal $PRNT_{50}$ score (e.g., less than about 1.9×, about 1.8×, about 1.7×, about 1.6×, about 1.5×, about 1.4×, about 1.3×, about 1.2×, about 1.1× the lowest score), or from about 4× or less to about 1.5× or less the lowest reciprocal $PRNT_{50}$ score. Also provided is a composition comprising a mixture of two or more recombinant polypeptides of two or more serotypes, wherein said composition does not show a level of immunodominance against one or more dengue viruses of serotypes not included in the composition.

The recombinant polypeptide(s) of the invention can be either a secreted or cell membrane bound (or associated) polypeptide(s). In many instances, the recombinant polypeptide desirably is a secreted polypeptide. For example, in one aspect, some secreted recombinant PRM15/tE polypeptides of the invention surprisingly are secreted more efficiently than a wild-type dengue virus PRM15/tE polypeptide of at least one virus serotype (e.g., more efficiently than a polypeptide comprising or consisting essentially of at least one of SEQ ID NOS:149-152) and more preferably more efficiently than a wild-type PRM15/tE polypeptide of any of the four virus serotypes (e.g., more efficiently than a polypeptide comprising or consisting essentially of any of SEQ ID NOS: 149-152). Some secreted recombinant C15/full prM/t E polypeptides of the invention are secreted more efficiently than a WT dengue virus C15/full prM/t E polypeptide of at least one virus serotype and preferably more efficiently than a WT C15/full prM/t E polypeptide of any of the four virus serotypes.

Some secreted recombinant C15/full prM/full E polypeptides of the invention are secreted more efficiently than a WT dengue virus C15/full prM/full E polypeptide of at least one virus serotype (e.g., more efficiently than a polypeptide comprising or consisting essentially of at least one of SEQ ID NOS:227-230) and preferably more efficiently than a WT C15/full prM/full E polypeptide of any of the four virus serotypes (e.g., more efficiently than a polypeptide comprising or consisting essentially of any of SEQ ID NOS:227-230).

Analysis of polypeptide or protein secretion can be performed by any suitable technique. For example, secretion levels can be determined by comparing the results of a Western blots/immunoblots performed with the supernatant of cells transfected with polynucleotides encoding such polypeptides and similar supernatants obtained from cells transfected with polynucleotides expressing corresponding WT dengue virus, where both such recombinant and WT polypeptides are expressed from a substantially identical expression cassette (e.g., an expression cassette comprising or consisting essentially of an identical promoter, enhancer, and polyA region sequences). See, e.g., a pMaxVax10.1 vector described below. The use of such a technique to analyze protein secretion is provided in the Examples below.

Measuring the expression level of a recombinant polypeptide of the invention (or a corresponding wild-type virus polypeptide for comparative purposes) can be carried out by any suitable technique. Examples of such techniques include Northern Blot analysis (discussed in, e.g., McMaster et al. (1997) *Proc Natl Acad Sci USA* 74:4835-38 (1977) and Sambrook, infra), reverse transcriptase-polymerase chain reaction (RT-PCR) (as described in, e.g., U.S. Pat. No. 5,601,820 and Zaheer et al. (1995) *Neurochem Res* 20:1457-63, and in situ hybridization techniques (as described in, e.g., U.S. Pat. Nos. 5,750,340 and 5,506,098). Quantification of proteins also can be accomplished by the Lowry assay and other classification protein quantification assays (see, e.g., Bradford (1976) *Anal Biochem* 72: 248-254 and Lowry et al. (1951) *J Biol Chem* 193:265). Western blot analysis of recombinant polypeptides of the invention obtained from the lysate of cells transfected with polynucleotides encoding such recombinant polypeptides is a preferred technique for assessing levels of recombinant polypeptide expression. The use of such a technique to assess recombinant polypeptide expression levels (and wild-type polypeptide expression levels for comparative purposes) is provided in the Examples below.

A particularly beneficial characteristic of polypeptides of the invention, and nucleic acids encoding such polypeptides, is the ability to induce a protective immune response in a subject, such as an animal, e.g., a mammal (including a primate), against challenge with at least one dengue virus of at least one serotype. Even more favorably, a polypeptide of the invention induces a protective immune response in a subject against challenge with one or more dengue viruses of each of at least two virus, at least three, and even at least four virus serotypes.

The induction of a protective immune response is determined, for example, by the lack of a disease condition(s) or symptom in a subject upon or following infection with the at least one dengue virus of the at least one serotype. In a mouse model, for example, induction of a protective immune response protects the mice against death usually seen after injection with a dengue virus. Such mouse models are regularly used for dengue virus vaccine testing (see, e.g., Johnson and Roehrig, *J. Virol.* 73(1):783-6 (1999)), although higher primate testing is preferred (e.g., a rhesus monkey model). In a human, induction of a protective immune response occurs when there is a detectable lessening, and preferably a complete non-occurrence of DF and/or DHF, upon infection with a dengue virus (preferably even after repeated infection with at least one dengue virus of each of multiple virus serotypes). Typically, though not necessarily, a protective polypeptide of the invention also induces the production of neutralizing antibodies against one or more dengue viruses or multiple virus serotypes (e.g., two, three or four serotypes).

The polypeptides of the invention can comprise any suitable combination of the above-described characteristics. For example, in one aspect, the invention provides a polypeptide (e.g., recombinant truncated E polypeptide) comprising an amino acid sequence that exhibits at least about 65%, preferably at least about 75% (e.g., about 80-95%) identity to at least one amino acid sequence selected from the group of SEQ ID NOS:1-49 and 153-155, wherein the polypeptide induces production of one or more antibodies that bind to one or more dengue viruses of each of the four virus serotypes in a subject more efficiently than an antibody induced by a WT truncated E protein polypeptide of the corresponding serotype.

In another aspect, the invention provides a polypeptide (e.g., recombinant or synthetic PRM15/tE polypeptide) comprising an amino acid sequence that exhibits at least about 65%, at least about 75%, preferably at least about 85%, 90%, or 95% amino acid sequence identity to at least one sequence selected from any of SEQ ID NOS:65-116, wherein the polypeptide induces production of one or more antibodies that bind to one or more dengue viruses of each of the four serotype more efficiently than any antibodies induced by any WT dengue virus polypeptides selected from SEQ ID NOS:149-152.

In another aspect, the invention provides a polypeptide (e.g., recombinant C15/full prM/full E polypeptide) comprising an amino acid sequence that exhibits at least about 65%, at least about 75% (e.g., about 80-95%), and/or preferably at least about 85% or 90% identity to at least one amino acid sequence selected from the group of SEQ ID NOS:39-148, and 236-253 (or selected from the group of SEQ ID NOS:39-145, 147-148 and 236-253 or any other group comprising a combination of two or more of these polypeptides), wherein the polypeptide induces production of antibodies that bind to one or more dengue viruses of each of the four virus serotypes in a subject more efficiently than at least one antibodies induced by any WT dengue virus polypeptide selected from SEQ ID NOS:227-230.

Recombinant tE polypeptides are desirably associated or extended with an ER-targeting signal amino acid sequence, which typically has substantially sequence identity with a C-terminal flaviviral prM amino acid sequence, and preferably has substantially identity with (or is selected from) (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) a dengue virus PRM15 sequence or a novel homolog thereof (e.g., a sequence selected from any of SEQ ID NOS:52-64), as described above, thereby forming a signal peptide/tE polypeptide, such as, e.g., a PRM15/tE polypeptide (e.g., any of SEQ ID NOS:1-49 and 153-155). Such a recombinant tE polypeptide or PRM15/tE polypeptide can be extended with a C terminal E protein fragment polypeptide as described above, such as, e.g., a sequence substantially identical (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with any of SEQ ID NOS:127-136 to form a recombinant full E polypeptide or PRM15/full E polypeptide. In addition or alternatively, a recombinant PRM15/tE polypeptide or a PRM15/full E polypeptide of the invention can be extended with an N terminal C15/truncated prM polypeptide as described above, such as, e.g., a sequence substantially identical (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with any one of SEQ ID NOS:117-126, to form a recombinant C15/full prM/tE or C15/full prM/full E polypeptide, respectively. Some such recombinant polypeptides are expressed and/or secreted at higher levels than prM/E fusion proteins formed from WT DEN sequences, as shown above and in Examples below.

Some such recombinant tE, full E, PRM15/tE, PRM15/full E, C15/full prM/full E, and C15/full prM/tE polypeptides also desirably exhibit the ability to induce a neutralizing antibody response against at least one dengue virus of at least one serotype, and preferably against one or more dengue viruses of multiple serotypes, in a subject, e.g., mammalian host. As noted above, some such polypeptides induce a higher neutralizing antibody titer against at least one dengue virus of at least one serotype than is induced against such at least one dengue virus of at least one serotype by a wild-type dengue polypeptide of similar size and configuration of the same or similar serotype (e.g., wild-type dengue virus tE, full E, PRM15/tE, PRM15/full E, C15/full prM/full E, C15/full prM/tE), as described above. Some such recombinant tE, full E, PRM15/tE, PRM15/full E, C15/full prM/full E, and C15/full prM/tE polypeptides also are able to induce a protective immune response against challenge by at least one dengue virus of at least one serotype in a subject host, and preferably exhibit the ability to induce a protective immune response against challenge by at one two dengue virus of each of at least two serotypes, in a subject host. Some such recombinant tE, full E, PRM15/tE, PRM15/full E, C15/full prM/full E, and C15/full prM/tE polypeptides of the invention are able to induce a protective immune response against challenge by at least one dengue virus of each DEN-1, DEN-2, DEN-3, and DEN-4 in a subject host. Desirably, such polypeptides induce such neutralizing antibody responses and/or protective immune responses against one or more viruses of two or more dengue virus serotypes without the occurrence of ADE.

In another preferred aspect, the invention provides a recombinant tE polypeptide comprising an amino acid sequence that has at least about 65% amino acid sequence identity, at least about 75% (e.g., about 80-95%), preferably at least about 85%, or at least about 90% or at least about 95% amino acid sequence identity with at least one amino acid sequence selected from the group of SEQ ID NOS:1-49 and 153-155, wherein the polypeptide induces a neutralizing antibody response to one or more dengue viruses of at least two virus serotypes in a subject. Preferably, such polypeptides induce a neutralizing antibody response to one or more dengue viruses of each of at least three virus serotypes, and, even more preferably, against one or more dengue viruses of each of dengue-1, dengue-2, dengue-3, and dengue-4 serotypes in the subject. Optionally, such neutralizing antibody (Ab) production produces higher neutralizing Ab titers than are obtained with a corresponding wild-type truncated E of one or more virus serotypes. These polypeptides also can be associated with any of the above-described characteristics, or combinations thereof, attendant polypeptides of the invention (e.g., inclusion of an ER-targeting sequence, inclusion of at least one C terminal E protein fragment polypeptide and/or at least one N terminal C15/truncated prM polypeptide, higher secretion, higher expression, and induction of a protective immune response in a subject such as a mammal to one or more dengue viruses of multiple serotypes without induction of ADE). Such polypeptides exhibit one or more of the characteristics of the polypeptides of the invention (e.g., ability to induce an immune response against at least one dengue virus of one or more serotypes; ability to induce an immune response against at least one dengue virus of one or more serotypes that is greater than that induced by a corresponding WT dengue polypeptide; ability to induce the production of neutralizing antibodies to one or more dengue viruses of multiple serotypes in a subject) or any suitable combination thereof. Such polypeptides are useful in methods of the invention described herein, including methods of inducing an immune response against at least one dengue virus of at least one serotype, methods of inducing a protective immune response against a dengue virus, and/or methods of detecting the presence of antibodies against dengue viruses of one or more serotypes in a sample.

In another aspect of the invention, the polypeptide comprises an amino acid sequence that has substantially identity (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with at least one of SEQ ID NOS:65-116. Preferred polypeptides comprise a sequence selected from any of SEQ ID NOS:65-116. Such polypeptides can comprise any of the above-described characteristics attendant polypeptides of the invention (e.g., ability to induce an immune response against at least one dengue virus of one or more serotypes; ability to induce an immune response against at least one dengue virus of one or more serotypes that is greater than that induced by a corresponding WT dengue polypeptide; ability to induce the production of neutralizing antibodies to one or more dengue viruses of multiple serotypes in a subject) or any suitable combination thereof, and are useful in methods of inducing an immune response against at least one dengue virus of at least one serotype, methods of inducing a protective immune response against a dengue virus, and/or methods of detecting or diagnosing the presence of antibodies against dengue viruses of one or more serotypes in a sample.

In yet another aspect, the invention provides a polypeptide comprising an amino acid sequence that has substantial sequence identity (e.g., at least about 65% amino acid sequence identity, desirably at least about 75% amino acid sequence identity, favorably at least about 80% or at least about 85% amino acid sequence identity, and preferably at least about 90% or at least about 95% amino acid sequence identity) with a sequence selected from any of SEQ ID NOS: 139-148, 236-253, 343, and 345, or selected from any of SEQ ID NOS:139-145, 147-148, 236-253, 343, and 345. Preferred polypeptides in this aspect comprise a sequence selected from the group of SEQ ID NOS:139-148, 236-253, 343, and 345. Such polypeptides can comprise any of the above-described characteristics attendant polypeptides of the invention (e.g., ability to induce an immune response against at least one dengue virus of one or more serotypes; ability to induce an immune response against at least one dengue virus of one or more serotypes that is greater than that induced by a corresponding WT dengue polypeptide; ability to induce the production of neutralizing antibodies to one or more dengue viruses of multiple serotypes in a subject) or any suitable combination thereof, and are useful in methods of inducing an immune response against at least one dengue virus of at least one serotype, methods of inducing a protective immune response against a dengue virus, and/or methods of detecting or diagnosing the presence of antibodies against dengue viruses of one or more serotypes in a sample.

In another aspect, the invention provides a recombinant truncated E polypeptide encoded by a nucleic acid comprising a polynucleotide sequence selected from the group of: (a) a polynucleotide sequence having at least about 85% sequence identity to at least one polynucleotide sequence selected from the group of SEQ ID NOS:285-330 or a complementary polynucleotide sequence thereof; (b) a RNA polynucleotide sequence comprising a DNA sequence selected from the group of SEQ ID NOS:285-330 in which all of the thymine nucleotide residues in the DNA sequence are replaced with uracil nucleotide residues or a complementary RNA polynucleotide sequence thereof; (c) a RNA polynucleotide sequence that has at least about 85% sequence identity to at least one RNA polynucleotide sequence of (b) or a complementary RNA polynucleotide sequence thereof; (d) a polynucleotide sequence that hybridizes under at least stringent conditions over substantially the entire length of a polynucleotide sequence of (a)-(c); (e) a polynucleotide sequence which would hybridize under at least stringent conditions over substantially the entire length of a polynucleotide sequence of any of (a)-(d) but for the degeneracy of the genetic code; and (f) a polynucleotide sequence that possesses any combination of the features of the polynucleotide sequences of (a)-(e).

In yet another aspect, the invention provides a recombinant PRM15/tE polypeptide encoded by a nucleic acid comprising a polynucleotide sequence selected from the group of: (a) a polynucleotide sequence having at least about 85% sequence identity to at least one polynucleotide sequence selected from the group of SEQ ID NOS:156-200 and 235, or a complementary polynucleotide sequence thereof; (b) a RNA polynucleotide sequence comprising a DNA sequence selected from the group of SEQ ID NOS:156-200 and 235 in which all of the thymine nucleotide residues in the DNA sequence are replaced with uracil nucleotide residues or a complementary RNA polynucleotide sequence thereof; (c) a RNA polynucleotide sequence that has at least about 85%, 90%, or 95% sequence identity to at least one RNA polynucleotide sequence of (b) or a complementary RNA polynucleotide sequence thereof; (d) a polynucleotide sequence that hybridizes under at least stringent conditions over substantially the entire length of a polynucleotide sequence of (a)-(c); (e) a polynucleotide sequence which would hybridize under at least stringent conditions over substantially the entire length of a polynucleotide sequence of any of (a)-(d) but for the degeneracy of the genetic code; and (f) a polynucleotide sequence that possesses any combination of the features of the polynucleotide sequences of (a)-(e). Such polypeptides exhibit any of the above-described characteristics attendant polypeptides of the invention and are useful in methods of the invention, e.g., methods of inducing an immune response against at least one dengue virus of at least one serotype, and/or methods of detecting or diagnosing the presence of antibodies against dengue viruses of one or more serotypes in a sample.

In another aspect, the invention includes a recombinant C15/full prM/full E polypeptide encoded by a nucleic acid comprising a polynucleotide sequence selected from the group of: (a) a polynucleotide sequence having at least about 85%, 90%, or 95% sequence identity to at least one polynucleotide sequence selected from the group of SEQ ID NOS: 201-210, 254-271, 342, and 344, or a complementary polynucleotide sequence thereof; (b) a RNA polynucleotide sequence comprising a DNA sequence selected from the group of SEQ ID NOS:201-210, 254-271, 342, and 344,in which all of the thymine nucleotide residues in the DNA sequence are replaced with uracil nucleotide residues or a complementary RNA polynucleotide sequence thereof; (c) a RNA polynucleotide sequence that has at least about 85% sequence identity to at least one RNA polynucleotide sequence of (b) or a complementary RNA polynucleotide sequence thereof; (d) a polynucleotide sequence that hybridizes under at least stringent conditions over substantially the entire length of a polynucleotide sequence of (a)-(c); (e) a polynucleotide sequence which would hybridize under at least stringent conditions over substantially the entire length of a polynucleotide sequence of any of (a)-(d) but for the degeneracy of the genetic code; and (f) a polynucleotide sequence that possesses any combination of the features of the polynucleotide sequences of (a)-(e). Such polypeptides exhibit any of the above-described characteristics attendant polypeptides of the invention and are useful in methods of the invention, e.g., methods of inducing an immune response against at least one dengue virus of at least one serotype, and/or methods of detecting or diagnosing the presence of antibodies against dengue viruses of one or more serotypes in a sample.

Recombinant polypeptides of the invention advantageously are capable of inducing an immune response to one or more dengue viruses of at least one, preferably at least two, more preferably at least three, and most preferably at least all four virus serotypes in a subject over sustained periods of time. For example, delivery or administration of an antigenic or immunogenic amount of at least one polypeptide of the invention to a subject induces a neutralizing antibody immune response to at least one dengue virus of at least one serotype for a period of at least about 30 days, at least about 40 days, desirably at least about 50, favorably at least about 70 or about 80 days, preferably at least about 100 days, more preferably at least about 120 days, and even more preferably at least about 180 days (e.g., about 3, 4, 6, or 9 months, about 1 year, 2 years, or longer) following delivery or administration of the at least one polypeptide to the subject.

In another aspect, delivery or administration of at least one polypeptide of the invention by delivery or administration of a suitable nucleic acid vector (e.g., a pMaxVax10.1 vector) comprising at least one polynucleotide encoding an antigenic or immunogenic amount of the at least one polypeptide, induces a neutralizing antibody immune response to at least one dengue virus of at least one serotype for a period of at least about 30 days, at least about 40 days, desirably at least about 50, favorably at least about 70 or about 80 days, preferably at least about 100 days, more preferably at least about 120 days, and even more preferably at least about 180 days (e.g., about 9 months, about 1 year, 2 years, or longer) after initial expression of the at least one polypeptide in a subject.

An immune response obtained by administration of a recombinant polypeptide of the invention (or polynucleotide or vector coding on expression for such a polypeptide, examples of which are further discussed herein), such as, e.g., a recombinant chimeric dengue virus PRM15/tE or C15/full prM/full E polypeptide, desirably lasts longer than the immune response induced by administration of a corresponding wild-type dengue virus polypeptide (e.g., wild-type dengue virus PRM15/tE or C15/full prM/full E polypeptide) or polynucleotide or vector coding on expression of such a wild-type dengue virus polypeptide.

In another aspect, the invention provides a recombinant or chimeric polypeptide including at least about 3, least about 5, at least about 6, at least about 7, at least about 8, at least about 10, at least about 15, at least about 20, at least about 25, at least about 30 or more amino acid (residue) sequence fragments of at least about 8 amino acid residues in length, at least about 10 amino acid residues in length, or at least about 15 amino acids in length, wherein such amino acid fragments are observed in one or more wild-type DEN-1, DEN-2, DEN-3, and DEN-4 prM/E amino acid sequences, and wherein such polypeptide comprises at least about 2 (preferably at least about 3, at least about 4, at least about 5, at least about 10, at least about 15, or more) non-contiguous fragments from any one wild-type dengue virus prM/E sequence. Such recombinant or chimeric polypeptides also or alternatively can promote or enhance an immune response, especially in the case of a humoral immune response, about equal to or greater than a recombinant or chimeric dengue virus antigen and/or flavivirus antigen consisting of 4 or less distinct dengue virus and/or flavivirus amino acid sequence fragments.

In one aspect, for example, the invention provides a recombinant or chimeric polypeptide comprising at least about 5 to about 20 amino acid sequence fragments comprising at least about 10 to about 40 amino acid residues in length, wherein such amino acid sequence fragments are non-contiguous fragments of one or more wild-type DEN-1, DEN-2, DEN-3, and DEN-4 prM/E amino acid sequences.

Nucleic Acids

The invention further provides a nucleic acid comprising a nucleotide sequence encoding any of the above-described polypeptides of the invention, including recombinant and chimeric tE, full length E, PRM15/tE, PRM15/full E, C15/full prM/full E, and C15/full prM/tE polypeptides of the invention. The terms "nucleic acid" and "polynucleotide" are synonymously used throughout in reference to such recombinant dengue antigen-encoding DNA, RNA, or other novel nucleic acid molecules of the invention, unless otherwise stated or clearly contradicted by context. The nucleic acid encoding a recombinant, synthetic, mutant, and/or isolated polypeptide of the invention can be any type of nucleic acid suitable for expressing a polypeptide of the invention (e.g., single stranded or double stranded RNA, DNA, or combinations thereof) and can include any suitable nucleotide base, base analog, and/or backbone (e.g., a backbone formed by, or including, a phosphothioate, rather than phosphodiester, linkage). Modifications to the nucleic acid are particularly tolerable in the 3rd position of an mRNA codon sequence encoding such a polypeptide. Examples of modified nucleotides that can be incorporated in the polynucleotide sequence are provided in, e.g., the MANUAL OF PATENT EXAMINING PROCEDURE §2422 (7th Revision—2000). Additional and alternative sequence modifications are described elsewhere herein. In some aspects, a nucleic acid of the invention may be an isolated nucleic acid. A nucleic acid of the invention may be termed a recombinant, synthetic, and/or mutant nucleic acid or polynucleotide; a recombinant, synthetic, and/or mutant nucleic acid or polynucleotide of the invention is often simply referred to as a "recombinant nucleic acid," "recombinant polynucleotide," or even more simply a "nucleic acid" or "polynucleotide." A nucleic acid of the invention may be referred to as a recombinant or synthetic dengue antigen-encoding nucleic acid.

In another aspect, a recombinant nucleic acid of the invention comprises any nucleotide sequence that results in the production (e.g., suitable production) of a recombinant polypeptide of the invention upon expression or translation in a desired host cell. Suitable production of a recombinant polypeptide of the invention may be the expression of an immunogenic amount or antigenic amount of the polypeptide of the invention. An "immunogen" is a molecule that induces, promotes, enhances, or modulates an immune response (e.g., in an in vitro cell-based assay or in vivo in a subject to which the immunogen is administered or ex vivo in cells (e.g., a subject's cells or tissue) that are transplanted into the subject). In one particular aspect, an "immunogen" is an antigen that elicits an immune response. In certain particular aspects, an immunogen is an antigen that elicits a strong immune response, particularly in the context of protective immunity to at least one pathogen (e.g., at least one flavivirus of at least one serotype). An "immunogenic amount" is typically an amount of a molecule, e.g., a polypeptide or polynucleotide, that is sufficient to induce, promote, enhance, or modulate an immune response in cells in vitro, and/or in vivo in a subject or ex vivo in a subject's cells or tissue(s). In one aspect, an immunogenic amount refers to an amount of an antigen that elicits an immune response that provides at least partial or complete protective immunity against at least one pathogen, such as a flavivirus (e.g., such as against at least one dengue virus of one or more serotypes). An immunogenic amount of a polypeptide may be produced by, e.g., administration or delivery of an immunogenic amount of the polypeptide itself to cells in vitro or to a population of cells or tissue(s) of a subject ex vivo or in vivo, or by administration or delivery of a nucleic acid that encodes an immunogenic amount of such polypeptide to cells in vitro or to a population of cells or tissue(s) of a subject ex vivo or in vivo.

Nucleic acids of the invention encode polypeptides of the invention that have one or more of the properties described above. Nucleic acids of the invention are similarly useful in methods of the invention, including a method of inducing an immune response against at least one flavivirus of at least one serotype (e.g., preferably, dengue virus) in a subject that comprises contacting, administering, or delivering a nucleic acid encoding at least one polypeptide of the invention to such subject (or to population of cells of the subject) and methods of inducing a protective immune response against at least one flavivirus of one or more serotypes (e.g., preferably, at least one dengue virus of two or more serotypes) in a subject that comprises contacting, administering, or delivering a nucleic acid encoding at least one polypeptide of the invention to such subject (or to a population of cells thereof).

As such, a nucleic acid of the invention is not limited to a nucleotide sequence that directly codes for expression or production of a polypeptide of the invention. For example, the nucleic acid can comprise a nucleotide sequence which results in a polypeptide of the invention through intein-like expression (as described in, e.g., Colson and Davis (1994) *Mol Microbiol* 12(3): 959-63, Duan et al. (1997) *Cell* 89(4): 555-64, Perler (1998) *Cell* 92(1):1-4, Evans et al (1999) *Biopolymers* 51(5):333-42, and de Grey, *Trends Biotechnol* (2000) 18(9):394-99), or a nucleotide sequence which comprises self-splicing introns (or other self-spliced RNA transcripts), which form an intermediate recombinant polypeptide-encoding sequence (as described in, e.g., U.S. Pat. No. 6,010,884). The polynucleotides also can comprise sequences which result in other splice modifications at the RNA level to produce an mRNA transcript encoding the polypeptide and/or at the DNA level by way of trans-splicing mechanisms prior to transcription (principles related to such mechanisms are described in, e.g., Chabot, *Trends Genet* (1996) 12(11):472-78, Cooper (1997) *Am J Hum Genet* 61(2):259-66, and Hertel et al. (1997) *Curr Opin Cell Biol* 9(3):350-57). Due to the inherent degeneracy of the genetic code, several nucleic acids can code for any particularly polypeptide of the invention. Thus, for example, any of the particular recombinant dengue-antigen-encoding nucleic acids described herein can be modified by replacement of one or more codons with an equivalent codon (with respect to the amino acid called for by the codon) based on genetic code degeneracy.

Polynucleotides of the invention can be obtained by application of any suitable synthesis, manipulation, and/or isolation techniques, or combinations thereof. For example, polynucleotides of the invention are typically and preferably produced through standard nucleic acid synthesis techniques, such as solid-phase synthesis techniques known in the art. In such techniques, fragments of up to about 100 bases usually are individually synthesized, then joined (e.g., by enzymatic or chemical ligation methods, or polymerase mediated recombination methods) to form essentially any desired continuous nucleic acid sequence. The synthesis of the nucleic acids of the invention can be also facilitated (or alternatively accomplished), by chemical synthesis using, e.g., the classical phosphoramidite method, which is described in, e.g., Beaucage et al. (1981) *Tetrahedron Letters* 22:1859-69, or the method described by Matthes et al. (1984) *EMBO J* 3:801-05, e.g., as is typically practiced in automated synthetic methods. The polynucleotide of the invention desirably by the phosphoramidite technique also preferably is accomplished by way of an automatic DNA synthesizer. Other techniques for synthesizing nucleic acids and related principles are described in, e.g., Itakura et al. (1984) *Annu Rev Biochem* 53:323, Itakura et al. (1984) *Science* 198:1056, and Ike et al. (1983) *Nucl Acid Res* 11:477.

Conveniently, custom made nucleic acids can be ordered from a variety of commercial sources, such as The Midland Certified Reagent Company (mcrc@oligos.com), the Great American Gene Company (http://www.genco.com), ExpressGen Inc. (www.expressgen.com), Operon Technologies Inc. (Alameda, Calif.). Similarly, custom peptides and antibodies can be custom ordered from any of a variety of sources, e.g., PeptidoGenic (pkim@ccnet.com), HTI Bioproducts, Inc. (http://www.htibio.com), and BMA Biomedicals Ltd. (U.K.), Bio.Synthesis, Inc.

Recombinant DNA techniques useful in modification of nucleic acids are well known in the art (e.g., restriction endonuclease digestion, ligation, reverse transcription and cDNA production, and PCR). Useful recombinant DNA technology techniques and principles related thereto are provided in, e.g., Mulligan (1993) *Science* 260:926-932, Friedman (1991) THERAPY FOR GENETIC DISEASES, Oxford University Press, Ibanez et al. (1991) *EMBO J* 10:2105-10, Ibanez et al. (1992) *Cell* 69: 329-41 (1992), and U.S. Pat. Nos. 4,440,859, 4,530,901, 4,582,800, 4,677,063, 4,678,751, 4,704,362, 4,710,463, 4,757,006, 4,766,075, and 4,810,648, and are more particularly described in Sambrook et al. (1989) MOLECULAR CLONING: A LABORATORY MANUAL, Cold Spring Harbor Press, and the third edition thereof (2001), Ausubel et al. (1994-1999), CURRENT PROTOCOLS IN MOLECULAR BIOLOGY, Wiley Interscience Publishers (with Greene Publishing Associates for some editions), Berger and Kimmel, "Guide to Molecular Cloning Techniques" in *Meth Enzymol*, 152, Acad. Press, Inc. (San Diego, Calif.), and Watson et al., RECOMBINANT DNA (2d ed.).

As described in more detail herein, recombinant nucleic acids of the invention include: (1) polynucleotide sequences that encode any of the above-described polypeptide sequences and immunogenic or antigenic fragments thereof (including, e.g., recombinant immunogenic tE, full E, PRM15/tE, PRM15/full E, C15/full prM/full E, and C15/full prM/tE polypeptides of the invention), and complementary sequences thereof; (2) polynucleotide sequences complementary to such polynucleotide sequences of (1) (and fragments thereof); polynucleotides that hybridize under at least stringent conditions to the nucleic acid sequences defined herein, including any polynucleotide sequence of (1) and (2), and complementary sequences thereof; (3) novel immunogenic or antigenic fragments of all such nucleic acid sequences, including those described in (1) and (2) above, which have one or more of the immune-response inducing properties set forth herein or encode one or more polypeptides have one or more of the immune-response inducing properties set forth herein, and complementary sequences of such fragments; and (4) variants, analogs, and homologue derivatives of all of the above.

The polynucleotides of the invention can be double-stranded or single-stranded, and if single-stranded, can be the coding strand or the non-coding (i.e., antisense or complementary) strand. In addition to a nucleotide sequence encoding a polypeptide of the invention, the polynucleotide of the invention can comprise one or more additional coding nucleotide sequences, so as to encode, e.g., a fusion protein, a pre-protein, a prepro-protein, a heterologous transmembrane domain, targeting sequence (other than a signal sequence), or the like (more particular examples of which are discussed further herein), and/or can comprise non-coding nucleotide sequences, such as introns, or 5' and/or 3' untranslated regions effective for expression of the coding sequence in a suitable host.

For example, a polynucleotide of the invention that encodes a truncated E or full E protein (i.e., tE-encoding or full E-encoding polynucleotide) may further comprise a nucleotide sequence that encodes an ER-targeting signal sequence positioned near to, or fused to, the tE-encoding or full E-encoding immunogenic sequence of the invention. Preferably, the signal sequence-encoding nucleic acid sequence encodes a signal sequence having the preferred features of signal sequences described above (e.g., a 15-amino acid fragment of the C terminal of a prM protein of a flavivirus, preferably a dengue virus, or a sequence having substantial identity therewith).

In one aspect, the invention provides a nucleic acid comprising a signal sequence-encoding sequence having substantial nucleotide sequence identity (e.g., at least about 65%, 70%, 75%, preferably at least about 80% or 85%, and more preferably at least about 90%, 91%, 92%, 93%, 94%, 95%, 96%, 97%, 98%, or 99% identity) with at least one of SEQ ID NOS:272-284, and preferably SEQ ID NOS:272-280. Such polynucleotide sequences, which encode signal peptides, are similarly useful as and in applications including the signal peptides of the invention discussed above. In one aspect, truncated E polypeptide-encoding or full length E polypeptide-encoding nucleic acids comprising a sequence selected from the group of SEQ ID NOS:272-284 are also a feature of the present invention.

The invention also provides novel nucleic acids useful in the production of recombinant dengue virus antigens and other applications (e.g., for use in methods of inducing an immune response against one or more dengue viruses and/or in therapeutic or prophylactic methods, as vaccines, in diagnostic methods and systems, as nucleic acid probes, in the amplification of smaller nucleic acid sequences that encode immunogenic fragments of such recombinant dengue virus antigens (such uses are discussed elsewhere herein)).

For example, in one respect, the invention provides a nucleic acid comprising a polynucleotide sequence that has substantial sequence identity (e.g., at least about 65%, 70%, 75%, preferably at least about 80% or 85%, and more preferably at least about 90%, 91%, 92%, 93%, 94%, 95%, 96%, 97%, 98%, or 99% identity) with the nucleotide sequence of at least one of SEQ ID NOS:285-330. In particular aspects, the nucleic acid comprises a sequence selected from the group of SEQ ID NOS:285-330. Such a nucleic acid encodes at least a recombinant truncated E polypeptide of the invention and is generally termed a recombinant tE polypeptide-encoding nucleic acid. Such nucleic acids having one or more of the properties of recombinant nucleic acids described below.

Nucleic acids consisting of and/or consisting essentially of such sequences such as the group of SEQ ID NOS:285-330 encode a polypeptide of a length approximately equal to a truncated E sized recombinant dengue antigen of the invention, as discussed above. Such nucleic acids are typically at least about 1300 nucleotides in length, and typically are about 1300-1375 nucleotides in length (e.g., about 1340 nucleotides in length).

The invention also provides a nucleic acid comprising first nucleotide sequence encoding recombinant truncated E polypeptide dengue antigens and a second nucleotide sequence encoding a signal peptide. For example, in one aspect, the invention provides a nucleic acid comprising a sequence that has substantial identity (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with at least one of SEQ ID NOS: 156-200 and 235. More desirably, the polynucleotide comprises a sequence selected from the group of SEQ ID NOS: 156-200 and 235. Such nucleic acids are typically at least about 1350 nucleotides in length, and more typically are about 1350-1400 nucleotides in length (e.g., about 1385 nucleotides in length). Such a nucleic acid encodes a PRM15/t E polypeptide and is generally termed a PRM15/tE polypeptide-encoding nucleic acid. In particular aspects, the nucleic acid comprises a sequence selected from the group of SEQ ID NOS:157-159, 185, 187, 172, 200, and 235. Such nucleic acids having one or more of the properties of recombinant nucleic acids are described below.

The invention also provides a nucleic acid sequence that has substantial sequence identity (e.g., at least about 65%, 70%, 75%, preferably at least about 80% or 85%, and more preferably at least about 90%, 91%, 92%, 93%, 94%, 95%, 96%, 97%, 98%, or 99% identity) with the nucleotide sequence of at least one of SEQ ID NOS:211-214. In particular aspects, the nucleic acid comprises a sequence selected from the group of SEQ ID NOS:211-214. These nucleotide sequences are human codon optimized nucleotide sequences encoding DEN-1, DEN-2, DEN-3, and DEN-4 PRM15/tE polypeptides, respectively, and are generally termed human CO WT PRM15/tE polypeptide-encoding nucleic acids. The polypeptides encoded by these nucleic acid sequences offer improved biological properties over non human codon-optimized (CO) wild-type PRM15/tE polypeptide-encoding nucleotide sequences. Such polynucleotides are markedly different in structure and lack substantial identity with non human CO wild-type PRM15/tE polypeptide-encoding nucleotide sequences. For example, the polypeptide encoded by these sequences are expressed at higher levels and/or are secreted at higher levels than similar PRM15/tE polypeptides expressed from non human CO WT dengue virus PRM15/tE sequences.

Also included is a nucleic acid sequence that has substantial sequence identity (e.g., a: least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with the nucleotide sequence of at least one of SEQ ID NOS:215-218. Some such nucleic acid comprises a sequence of at least about 1800 nucleotides. In particular aspects, the nucleic acid comprises a sequence selected from the group of SEQ ID NOS:215-218. These nucleic acid sequences are human codon optimized nucleotide sequences that encode DEN-1, DEN-2, DEN-3, and DEN-4 C15/full prM/full E polypeptides, respectively, and are termed human CO WT C15/full prM/full E polypeptide-encoding nucleic acids. These encoded polypeptides exhibit improved biological properties compared to C15/full prM/full E polypeptides expressed from non human CO wild-type C15/full prM/full E polypeptide-encoding nucleic acids. For example, the polypeptides encoded by these sequences are expressed at higher levels and/or are secreted at higher levels than similar C15/full prM/full E polypeptides expressed from non human CO wild-type C15/full prM/full E polypeptide-encoding nucleic acid sequences.

The invention also provides a recombinant nucleic acids that encode, e.g., antigenic fusion proteins each comprising: (1) a C15 dengue virus signal sequence (which also includes a Met residue as the first residue of the signal sequence, thereby forming a 16-amino acid signal sequence); (2) a full length prM dengue virus sequence; and 3) a full length envelope (E) protein sequence, wherein these three sequences are fused together in the order 1, 2, and 3. In another aspect, the invention provides recombinant nucleic acids encoding antigenic fusion proteins that each comprise a full length prM dengue virus sequence fused to a full length envelope (E) protein sequence.

In another aspect, the invention provides a nucleic acid comprising at least a first polynucleotide sequence comprising a tE polypeptide-encoding polynucleotide sequence or a PRM15/tE polypeptide-encoding polynucleotide sequence and at least a second polynucleotide sequence that encodes a polypeptide sequence that has at least about 55%, preferably at least about 65%, and more preferably at least about 75% (e.g., at least about 80%, at least about 85%, at least about 90%, at least about 95%, or more) amino acid sequence identity with a sequence selected from the group of SEQ ID NOS:127-136. Alternatively, the second polynucleotide sequence that has at least about 55%, preferably at least about 65%, and more preferably at least about 75% (e.g., at least about 80%, at least about 85%, at least about 90%, at least about 95%, or more) nucleotide identity with a sequence selected from the group of SEQ ID NOS:223-226. In some aspects, it is desirable that such nucleic acids comprise a sequence selected from the group of SEQ ID NOS:223-226.

In another aspect, the invention provides a nucleic acid comprising a polynucleotide sequence that has substantial sequence identity (e.g., at least about 65%, 70%, 75%, 80%, 85%, 90%, 91%, 92%, 93%, 94%, 95%, 96%, 97%, 98%, or 99% identity) with the nucleotide sequence of at least one of SEQ ID NOS:201-210, 254-271, 342, and 344. In particular aspects, the nucleic acid comprises a sequence selected from the group of SEQ ID NOS:201-210, 254-271, 342, and 344. Such a nucleic acid encodes a recombinant C15/full length prM/full length E polypeptide of the invention and is generally termed a recombinant C15/full prM/full E polypeptide-encoding nucleic acid. Such nucleic acids having one or more properties of the recombinant nucleic acids are described below.

The invention also provides nucleic acids that hybridize with any of the disclosed and/or above-described nucleic acid sequences of the invention under at least moderately stringent hybridization conditions, at least stringent hybridization conditions, at least highly stringent hybridization conditions, or preferably very stringent hybridization conditions over substantially the entire length of a nucleic acid. "Substantially the entire length of a nucleic acid sequence" refers to at least about 50%, generally at least about 60%, at least about 70%, or at least about 75%, usually at least about 80%, at least about 85%, at least about 88%, and typically at least about 90%, e.g., at least about 91%, about 92%, about 93%, about 94%, about 95%, about 96%, about 97%, about 98%, about 99%, about 99.5%, or more, of the length of the nucleic acid sequence. Thus, the invention provides a polynucleotide that comprises a nucleic acid sequence (a test sequence) that hybridizes to at least about 50%, preferably at least about 65%, and more preferably at least about 80% of a reference sequence (e.g., a nucleic acid sequence disclosed herein, such as, for example, a sequence selected from the group of SEQ ID NOS:156-218, 235, 254-271, 285-330, 342, and 344,). More preferably, the hybridizing nucleic acid hybridizes to the disclosed nucleic acid sequence (e.g., a sequence selected from said above-referenced SEQ ID NOS) under at least stringent conditions, and, even more preferably under at least high stringency conditions. Moderately stringent, stringent, and highly stringent hybridization conditions for nucleic acid hybridization experiments are known in the art. As such, only examples of the factors that can be combined to achieve such levels of stringency are briefly discussed herein.

Exemplary moderate stringency conditions include overnight incubation at 37° C. in a solution comprising 20% formalin (or formamide), 0.5×SSC, 50 mM sodium phosphate (pH 7.6), 5× Denhardt's solution, 10% dextran sulfate, and 20 mg/mL denatured sheared salmon sperm DNA, followed by washing the filters in 1×SSC at about 37-50° C., or substantially similar conditions, e.g., the moderately stringent conditions described in Sambrook et al., supra, and/or Ausubel, supra.

Exemplary stringent (or regular stringency) conditions for analysis of nucleic acids comprising at least 100 nucleotides include incubation in a solution comprising 50% formalin (or formamide) with 1 mg of heparin at 42° C., with the hybridization being carried out overnight. A regular stringency wash can be carried out using, e.g., a solution comprising 0.2×SSC wash at about 65° C. for about 15 minutes (see Sambrook, supra, for a description of SSC buffer). Often, the regular stringency wash is preceded by a low stringency wash to remove background probe signal. A low stringency wash can be carried out in, for example, a solution comprising 2×SSC at about 40° C. for about 15 minutes. A highly stringent wash can be carried out using a solution comprising 0.15 M NaCl at about 72° C. for about 15 minutes. An example medium (regular) stringency wash, less stringent than the regular stringency wash described above, for a duplex of, e.g., more than 1.00 nucleotides, can be carried out in a solution comprising 1×SSC at 45° C. for 15 minutes. An example low stringency wash for a duplex of, e.g., more than 100 nucleotides, is carried out in a solution of 4-6×SSC at 40° C. for 15 minutes. For short probes (e.g., about 10 to 50 nucleotides), stringent conditions typically involve salt concentrations of less than about 1.0 M $Na^+$ ion, typically about 0.01 to 1.0 M $Na^+$ ion concentration (or other salts) at pH 7.0 to 8.3, and the temperature is typically at least about 30° C. Stringent conditions can also be achieved with the addition of destabilizing agents such as formamide.

High stringency conditions are conditions that use, for example, (1) low ionic strength and high temperature for washing, such as 0.015 M sodium chloride/0.0015 M sodium citrate/0.1% sodium dodecyl sulfate (SDS) at 50° C., (2) employ a denaturing agent during hybridization, such as formamide, e.g., 50% (v/v) formamide with 0.1% BSA/0.1% Ficoll/0.1% polyvinylpyrrolidone (PVP)/50 mM sodium phosphate buffer at pH 6.5 with 750 mM sodium chloride, 75 mM sodium citrate at 42° C., or (3) employ 50% formamide, 5×SSC (0.75 M NaCl, 0.075 M sodium citrate), 50 mM sodium phosphate (pH 6.8), 0.1% sodium pyrophosphate, 5× Denhardt's solution, sonicated salmon sperm DNA (50 µg/mL), 0.1% SDS, and 10% dextran sulfate at 42° C., with washes at (i) 42° C. in 0.2×SSC, (ii) at 55° C. in 50% formamide and (iii) at 55° C. in 0.1×SSC (preferably in combination with EDTA).

More generally or alternatively, high stringency conditions are selected such that hybridization occurs at about 5° C. or less than the thermal melting point ($T_m$) for the specific sequence at a defined ionic strength and pH. The $T_m$ is the temperature (under defined ionic strength and pH) at which 50% of the test sequence hybridizes to a perfectly matched probe. In other words, the $T_m$ indicates the temperature at which the nucleic acid duplex is 50% denatured under the given conditions and its represents a direct measure of the stability of the nucleic acid hybrid. Thus, the $T_m$ corresponds to the temperature corresponding to the midpoint in transition from helix to random coil; it depends on length, nucleotide composition, and ionic strength for long stretches of nucleotides. Typically, under "stringent conditions," a probe will hybridize to its target subsequence, but to no other sequences. "Very stringent conditions" are selected to be equal to the $T_m$ for a particular probe.

The $T_m$ of a DNA-DNA duplex can be estimated using equation (1): $T_m$ (° C.)=81.5° C.+16.6 ($\log_{10}$ M)+0.41 (%G+C)−0.72 (%f)−500/n, where M is the molarity of the monovalent cations (usually $Na^+$), (%G+C) is the percentage of guanosine (G) and cytosine (C) nucleotides, (%f) is the percentage of formalize and n is the number of nucleotide bases (i.e., length) of the hybrid. See Rapley and Walker, MOLECULAR BIOMETHODS HANDBOOK supra. The $T_m$ of an RNA-DNA duplex can be estimated using equation (2): $T_m$ (°

C.)=79.8° C.+18.5 ($\log_{10}$ M)+0.58 (%G+C)−11.8(%G+C)$^2$− 0.56 (%f)−820/n, where M is the molarity of the monovalent cations (usually Na$^+$), (%G+C) is the percentage of guanosine (G) and cytosine (C) nucleotides, (%f) is the percentage of formamide and n is the number of nucleotide bases (i.e., length) of the hybrid. Id. Equations 1 and 2 above are typically accurate only for hybrid duplexes longer than about 100-200 nucleotides. Id. The Tm of nucleic acid sequences shorter than 50 nucleotides can be calculated as follows: $T_m$ (° C.)=4 (G+C)+2(A+T), where A (adenine), C, T (thymine), and G are the numbers of the corresponding nucleotides.

In general, unhybridized nucleic acid material desirably is removed by a series of washes, the stringency of which can be adjusted depending upon the desired results, in conducting hybridization analysis. Low stringency washing conditions (e.g., using higher salt and lower temperature) increase sensitivity, but can product nonspecific hybridization signals and high background signals. Higher stringency conditions (e.g., using lower salt and higher temperature that is closer to the hybridization temperature) lower the background signal, typically with only the specific signal remaining. Addition useful guidance concerning such hybridization techniques is provided in, e.g., Rapley and Walker, MOLECULAR BIOMETHODS HANDBOOK, supra (in particular, with respect to such hybridization experiments, part I, chapter 2, "Overview of principles of hybridization and the strategy of nucleic acid probe assays"), Elsevier, New York, as well as in Ausubel, supra, Sambrook et al., supra, Watson et al., supra, Hames and Higgins (1995) GENE PROBES 1, IRL Press at Oxford University Press, Oxford, England, and Hames and Higgins (1995) GENE PROBES 2, IRL Press at Oxford University Press, Oxford, England.

Preferably, the hybridization analysis is carried out under hybridization conditions selected such that a perfectly complementary oligonucleotide to the recombinant dengue antigen-encoding sequence or otherwise disclosed sequence hybridizes with the recombinant dengue antigen-encoding sequence with at least about 2 times (2×) (e.g., about 2.5 times), desirably at least about 5 times, preferably at least about 7 times, and more preferably at least about 10 times, higher signal-to-noise ratio than for hybridization of the perfectly complementary oligonucleotide to a control nucleic acid comprising a polynucleotide sequence that is at least about 90% identical to a polynucleotide sequence that encodes approximately the same length WT dengue virus polypeptide or encodes a corresponding WT dengue virus polypeptide. For example, if the recombinant sequence is a PRM15/tE-encoding polynucleotide sequence, a control nucleic acid may be a wild-type PRM15/tE-encoding polynucleotide that encodes a DEN-1 PRM15/tE, DEN-2 PRM15/tE, DEN-3 PRM15/tE, or DEN-4 PRM15/tE polypeptide or the control nucleic acid may comprises a polynucleotide sequence that is at least about 90% identity with the nucleotide sequence of any of: SEQ ID NO:231 (DEN-1 PRM15/E trunc WT cDNA sequence comprising nucleic acid residues 894-2285 of GenBank Ace. No. AB074761); SEQ ID NO:232 (DEN-2 PRM15/E trunc WT cDNA sequence comprising nucleic acid residues 892-2274 of GenBank Acc. No. NC_001474); SEQ ID NO:233 (DEN-3 PRM15/E trunc WT cDNA sequence comprising nucleic acid residues 893-2263 of GenBank Acc. No. M25277); and SEQ ID NO:234 (DEN-4 PRM15/E trunc WT cDNA sequence comprising nucleic acid residues 894-2285 of GenBank Acc. No. M14931). Such conditions can be considered indicative for specific hybridization.

The above-described hybridization conditions can be adjusted, or alternative hybridization conditions selected, to achieve any desired level of stringency in selection of a hybridizing nucleic acid sequence. For example, the above-described highly stringent hybridization and wash conditions can be gradually increased (e.g., by increasing temperature, decreasing salt concentration, increasing detergent concentration and/or increasing the concentration of organic solvents, such as formalin, in the hybridization or wash), until a selected set of criteria are met. For example, the hybridization and wash conditions can be gradually increased until a desired probe, binds to a perfectly matched complementary target, with a signal-to-noise ratio that is at least about 2.5×, and optionally at least about 5× (e.g., about 10×, about 20×, about 50×, about 100×, or even about 500×), as high as the signal-to-noise ration observed from hybridization of the probe to a nucleic acid not of the invention, such as a known nucleic acid sequence selected from GenBank, and/or a wild-type dengue virus nucleic acid sequence, including, e.g., a wild-type dengue virus nucleic acid encoding a wild-type dengue virus truncated E polypeptide, full E polypeptide, PRM15/tE polypeptide, PRM15/full E polypeptide, or C15/full prM/full E polypeptide. In hybridization analyses, a recombinant polypeptide of the invention is typically compared with or analyzed in view of a wild-type polypeptide of approximately the same length or comprising the same or similar format (e.g., a recombinant C15/full prM/full E polypeptide of the invention is compared with a wild-type flavivirus C15/full prM/full E polypeptide).

In one aspect, the invention provides a nucleic acid comprising a sequence of at least about 900 nucleotides (including, e.g., at least about 900-3000 nucleotides, at least about 1000-2000 nucleotides), preferably at least about 1200 nucleotides, and more preferably at least about 1300 nucleotides, that encodes an amino acid sequence that induces an immune response to a dengue virus in a subject, wherein the nucleic acid selectively hybridizes under at least moderately stringent conditions to at least one of SEQ ID NOS:156-200 and 235 as compared to a wild-type PRM15/tE-encoding sequence (e.g., SEQ ID NOS:231-234) or a portion or fragment thereof. In one aspect, for example, the nucleic acid of the invention preferably hybridizes to at least one of SEQ ID NOS:156-200 and 235 as compared to a WT PRM15/truncated E-encoding sequence from DEN-3 (e.g., nucleotides 893-2263 of the nucleotide sequence recorded under GenBank Accession No. M25277). Preferably, the nucleic acid selectively hybridizes to at least one of SEQ ID NOS:156-200 and 235, as compared to such WT PRM15/tE-encoding sequences and/or PRM15/tE-encoding sequences of any known wild-type and/or modified (e.g., attenuated strain) virus, including flaviviruses (and dengue viruses) shown in GenBank. The determination of those segments of wild-type flaviviral nucleotide sequences or WT flaviviral genomes that encode, e.g., a WT PRM15/truncated E protein, WT PRM15/full E protein, WT C15/full prM/full E protein is within the abilities of one of ordinary skill in the art.

In another aspect, the invention provides a nucleic acid comprising a sequence of at least about 900 nucleotides, usually at least about 1000 nucleotides, typically at least about 1100 or about 1200 nucleotides, and more preferably at least about 1300 nucleotides, that encodes an amino acid sequence that induces an immune response to a dengue virus in a subject, wherein the nucleic acid selectively hybridizes under moderately stringent conditions to at least one of SEQ ID NOS:211-218 as compared to any of SEQ ID NOS:231-234 or another known PRM15/tE-encoding dengue virus polynucleotide. Desirably, such a nucleic acid of the invention hybridizes to at least one of SEQ ID NOS:211-218 more selectively than it hybridizes to any of SEQ ID NOS:231-234 or another known PRM15/tE-encoding dengue virus polynucleotide under highly stringent conditions, preferably under regularly stringent conditions, and, most preferably, under moderately stringent conditions.

The invention also provides nucleic acids comprising a sequence that does not hybridize to one of the specifically disclosed nucleic acid sequences of the invention (e.g., to a sequence selected from the group of SEQ ID NOS:156-218, 235, 253-271, 285-330, 342, and 344,), but would so hybridize but for the degeneracy of the nucleic acid code and/or the imposition of non-coding sequences (e.g., nucleotide sequences that are spliced out of a DNA sequence to form an RNA intermediate that encodes a polypeptide having an amino acid sequence substantially identical (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with that of any recombinant polypeptide sequence of the invention) that do not impact on the ability of the otherwise hybridizing nucleic acid (target or test nucleic acid) to express a polypeptide that is structurally, functionally, or otherwise similar to at least one of the recombinant polypeptides of the invention. Such non-hybridizing, but related, target sequences desirably are at least about 60, desirably at least about 300, preferably at least about 900, more preferably at least about 1200, and more preferably at least about 1300 nucleotides in length.

In one aspect, the invention provides a nucleic acid that encodes a polypeptide comprising an immunogenic amino acid sequence of at least about 400 amino acid residues that has substantial identity (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with at least one of SEQ ID NOS:1-49 and 153-155. In another aspect, the invention includes a the nucleic acid that encodes a polypeptide comprising an immunogenic amino acid sequence of at least about 450 amino acid residues that exhibits substantial identity (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) to at least one sequence selected from the group of SEQ ID NOS:65-116. More particularly, the nucleic acid encodes a polypeptide comprising an immunogenic amino acid sequence of at least about 400 amino acid residues that has substantial identity (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with at least one sequence selected from any of SEQ ID NOS:66, 67, 69, 89, 93, and 108-110.

In another aspect, the invention provides a nucleic acid that encodes a polypeptide that comprises an immunogenic amino acid sequence of at least about 650 amino acid residues that exhibits substantial identity (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with at least one of SEQ ID NOS:139-148, 236-253, 343, and 345. More particularly, the nucleic acid encodes a polypeptide comprising an immunogenic amino acid sequence of at least about 650 amino acid residues that has substantial identity (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with any of SEQ ID NOS:140-141. Preferably, the nucleic acid encodes a polypeptide comprising SEQ ID NO:141 or 140.

The nucleic acids of the invention desirably encode a polypeptide that induces an immune response to at least one dengue virus of at least one serotype in a subject. More preferably, the nucleic acid comprises a sequence that encodes at least one polypeptide comprising an immunogenic amino acid sequence that induces an immune response to at least one dengue virus of each of four virus serotypes in a subject. Desirably, the amino acid encoded by such a nucleic acid sequence induces an immune response against at least one dengue virus of at least one serotype in a subject that is at least equal to or greater than the immune response induced against at least one dengue virus of at least one serotype in the subject by a corresponding wild-type dengue virus polypeptide of a particular serotype. Desirably, the nucleic acid encodes a polypeptide that exhibits a humoral and cellular immune response to a dengue virus, preferably to one or more dengue viruses of multiple (optimally all four) virus serotypes in a subject (e.g., a recombinant C15/full prM/full E polypeptide, such as, e.g., a polypeptide comprising the sequence of SEQ ID NO:141), where at least the humoral, the cellular, or preferably both immune responses promoted/induced by the encoded polypeptide are about equal to or greater than the corresponding humoral response, cellular response, and/or both such immune responses, respectively, that are induced/promoted by a corresponding wild-type dengue virus polypeptide (e.g., wild-type dengue virus C15/full prM/full E polypeptide of one or more serotypes).

In one aspect, the recombinant nucleic acid comprises a polynucleotide sequence that encodes at least one polypeptide that induces the production of one or more neutralizing antibodies in a subject against at least one dengue virus of at least one serotype. In a particular aspect, the recombinant nucleic acid encodes a polypeptide that induces the production of neutralizing antibodies against at least one dengue virus of each of at least two, at least three, or preferably at least four serotypes in a subject. Preferably, the nucleic acid encodes a polypeptide that induces a titer of neutralizing antibodies against at least one dengue virus of at least one serotype that is at least equal to or greater than the titer of neutralizing antibodies induced against the at least one dengue virus of the at least one serotype by a wild-type nucleic acid encoding a wild-type dengue virus antigen of the same or similar size and of the same format. For example, in one aspect, a PRM15/tE polypeptide-encoding nucleic acid (e.g., SEQ ID NOS:156-200 and 235) is provided that encodes a polypeptide that induces a titer of neutralizing antibodies against at least one dengue virus of at least one serotype that is at least equal to or greater than the titer of neutralizing antibodies induced against the at least one dengue virus of the at least one serotype by a wild-type PRM15/tE polypeptide-encoding nucleic acid (e.g., any of SEQ ID NOS:149-152).

Preferably, a recombinant nucleic acid of the invention comprises a polynucleotide sequence that encodes an immunogenic polypeptide (e.g., a nucleic acid encoding a recombinant tE, full E, PRM15/tE, C15/full prM/full E, PRM15/full E, or prM/full E polypeptide) that induces the production of one or more neutralizing antibodies to at least one dengue virus of each of the four serotypes in a subject. The neutralizing antibody response induced by such encoded immunogenic polypeptide typically does not induce ADE in a mammal upon infection of the mammal with a dengue virus and/or upon secondary infection of the mammal with a dengue virus of a different serotype than the serotype of the virus the mammal was infected with before receiving the recombinant nucleic acid.

In another aspect, a recombinant nucleic acid of the invention comprises a polynucleotide sequence that encodes a polypeptide that induces a protective immune response to at least one dengue virus of at least one serotype in a subject. In another aspect, the nucleic acid comprises a polynucleotide sequence that encodes a polypeptide that induces a protective immune response against at least one dengue virus of each of at least two, preferably at least three, and more preferably against all four virus serotypes when the polypeptide is expressed in a subject.

The invention further provides a nucleic acid comprising a fragment of the one of the nucleic acids of the invention that encodes a polypeptide that induces an immune response against at least one dengue virus in a subject, which fragment is unique as compared to WT dengue virus antigens of similar size and/or format. Preferably, the nucleic acid fragment encodes a polypeptide that induces an immune response to at least one dengue virus of all four serotypes, and, more preferably, induces production of a neutralizing antibody and/or protective immune response against at least one dengue virus of all four serotypes, in a subject (most desirably without the occurrence of ADE).

The nucleic acid of the invention can comprise any suitable number of other sequences in addition to the above-described recombinant dengue antigen-encoding sequences and also or alternatively can comprise any suitable number of recombinant dengue antigen-encoding sequences. For example, a nucleic acid can comprise two or more copies of a dengue antigen-encoding sequence and/or nucleotide sequences encoding multiple different dengue antigen-encoding sequences. For example, a nucleic acid can comprise one or more of the following: (1) a nucleotide sequence encoding a recombinant C15/full prM/full E polypeptide; (2) a nucleotide sequence encoding a recombinant full prM/full E polypeptide; (3) a nucleotide sequence encoding a recombinant PRM15/tE polypeptide; (4) a nucleotide sequence encoding a WT or recombinant signal peptide, C15 or PRM15; (5) a nucleotide sequence encoding a recombinant tE polypeptide; and (6) a nucleotide sequence encoding a recombinant full E polypeptide.

In one particular aspect, the nucleic acid comprises a second sequence encoding an adjuvant and/or a cytokine, a costimulatory molecule (e.g., a mammalian B7-1 or B7-2 or an amino acid sequence that has at least substantial identity thereto or comprises a variant thereof), or a heterologous antigen (e.g., a yellow fever antigen, a malaria vaccine, etc.). The nucleic acid can comprise any suitable number and copy of such sequences, in any suitable combination, along with the recombinant dengue antigen-encoding sequence(s). The sequences can be part of a single expression cassette, but more typically and preferably are contained in separate expression cassettes (examples of which are discussed further below). In some aspects, the recombinant dengue antigen-encoding sequence and the secondary nucleic acid sequence (e.g., the cytokine-encoding sequence) are operably linked to separate and different expression control sequences, such that they are expressed at different times and/or in response to different conditions (e.g., in response to different inducers).

In general, any of the nucleic acids of the invention can be modified to increase expression in a particular host, using the techniques exemplified herein with respect to the above-described dengue virus prM/E fusion protein-encoding sequences. Codons that are utilized most often in a particular host are called optimal codons, and those not utilized very often are classified as rare or low-usage codons (see, e.g., Zhang, S. P. et al. (1991) *Gene* 105:61-72). Codons can be substituted to reflect the preferred codon usage of the host, a process called "codon optimization" or "controlling for species codon bias." Optimized coding sequence comprising codons preferred by a particular prokaryotic or eukaryotic host can be used to increase the rate of translation or to produce recombinant RNA transcripts having desirable properties, such as a longer half-life, as compared with transcripts produced from a non-optimized sequence. Techniques for producing codon optimized sequences are known (see, e.g., E. et al. (1989) *Nuc Acids Res* 17:477-508). Translation stop codons can also be modified to reflect host preference. For example, preferred stop codons for *S. cerevisiae* and mammals are UAA and UGA respectively. The preferred stop codon for monocotyledonous plants is UGA, whereas insects and *E. coli* prefer to use UAA as the stop codon (see, e.g., Dalphin, M. E. et al. (1996) *Nuc Acids Res* 24:216-218). The arrangement of codons in context to other codons also can influence biological properties of a nucleic acid sequences, and modifications of nucleic acids to provide a codon context arrangement common for a particular host also is contemplated by the inventors. Thus, a nucleic acid sequence of the invention can comprise a codon optimized nucleotide sequence, i.e., codon frequency optimized and/or codon pair (i.e., codon context) optimized for a particular species (e.g., the polypeptide can be expressed from a polynucleotide sequence optimized for expression in humans by replacement of "rare" human codons based on codon frequency, or codon context, such as by using techniques such as those described in Buckingham et al. (1994) *Biochimie* 76(5):351-54 and U.S. Pat. Nos. 5,082,767, 5,786,464, and 6,114,148). An exemplary technique for producing codon optimized sequences is provided in Example 1.

In addition to the above-described codon optimized nucleic acid sequences (e.g., recombinant tE-encoding polynucleotide sequence, full E-encoding polynucleotide sequence, PRM15/tE-encoding polynucleotide sequence, C15/fill length prM/full length E-encoding polynucleotide sequence, etc.), the nucleic acids of the invention generally express polypeptides at expression levels higher than does a corresponding wild-type polynucleotide sequence encoding a wild-type dengue virus polypeptide sequences (e.g., WT dengue virus tE-encoding polynucleotide sequence, WT dengue virus full E-encoding polynucleotide sequence, WT dengue PRM15/tE-encoding polynucleotide sequence, WT C15/full length prM/full length E-encoding polynucleotide sequence, etc.). Thus, for example, the invention provides nucleic acids encoding one or more recombinant PRM15/tE polypeptides of the invention, wherein at least one such recombinant polypeptide is expressed more efficiently than a nucleic acid comprising at least a portion of any one of SEQ ID NOS:231-234, of substantially the same length, when expressed from a substantially identical expression cassette in a subject host, such as a mammalian host.

Remarkably, some recombinant C15/full prM/full E polypeptides of the invention, expressed from the C15/full prM/full E polypeptide-encoding polynucleotides described herein, also exhibit higher levels of secretion than codon optimized C15/full prM/full E polypeptide-encoding sequences (e.g., any of SEQ ID NOS:215-218).

The nucleic acid is typically a DNA, and usually a double stranded DNA sequence. However, the invention also provides single stranded DNA, single stranded RNA, double stranded RNA, and hybrid DNA/RNA nucleic acids comprising the nucleic acid sequences of the invention also are provided. In one aspect, the invention includes a RNA sequence comprising any DNA nucleotide sequence of the invention described herein and throughout in which the thymine nucleotides in the sequence are replaced with uracil nucleotides. The invention also provides, for example, an RNA nucleic acid comprising a sequence having substantially identity (e.g., having at least about 75%, 80%, 85%, 90%, 95% or more nucleic sequence identity) with at least one sequence selected from the group of SEQ ID NOS:156-218, 235, 254-271, 285-330, 342, and 344,). Also provided is a RNA nucleic acid comprising a DNA sequence selected from any of this group of sequences in which all of the thymine nucleotides in the DNA sequence are replaced with uracil nucleotides, and RNA polynucleotide sequences complementary to all such RNA nucleic acids.

The invention further provides a RNA nucleic acid that exhibits substantial identity with a sequence having substantial identity (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with at least one selected from the group of SEQ ID NOS: 285-330. More particularly, the invention provides a RNA nucleic acid comprising a DNA sequence selected from any of SEQ ID NOS:285-330 in which each thymine residue in the DNA sequence is replaced with a uracil residue. Such RNA nucleic acids typically are at least about 1000 nucleotides, typically about 1200 nucleotides, and typically about 2000 nucleotides in length. The invention also provides at least one fragment of such an RNA nucleic acid that encodes an immunogenic amino acid sequence of the invention, and RNA polynucleotide sequences that are complementary to such fragments. Also included is an RNA polynucleotide sequence that hybridizes to such an RNA nucleic acid (e.g., comprising a DNA sequence of any of SEQ ID NOS:285-330 in which each thymine nucleotides in the sequence is replaced with uracil nucleotide) under at least moderately stringent, preferably at least regularly stringent, and more preferably at least highly stringent hybridization conditions.

In one aspect of the invention, the invention provides a DNA nucleic acid that comprises at least one expression control sequence associated with and/or typically operably linked to a recombinant nucleic acid sequence of the invention (e.g., the recombinant antigen-encoding sequence). An "expression control sequence" is any nucleic acid sequence that promotes, enhances, or controls expression (typically and preferably transcription) of another nucleic acid sequence. Suitable expression control sequences include constitutive promoters, inducible promoters, repressible promoters, and enhancers.

Promoters exert a particularly important impact on the level of recombinant polypeptide expression. The nucleic acid of the invention (e.g., recombinant DNA nucleic acid) can comprise any suitable promoter. Examples of suitable promoters include the cytomegalovirus (CMV) promoter, the HIV long terminal repeat promoter, the phosphoglycerate kinase (PGK) promoter, Rous sarcoma virus (RSV) promoters, such as RSV long terminal repeat (LTR) promoters, mouse mammary tumor virus (MMTV) promoters, HSV promoters, such as the Lap2 promoter or the herpes thymidine kinase promoter (as described in, e.g., Wagner et al. (1981) *Proc Natl Acad Sci* 78:144-145), promoters derived from SV40 or Epstein Barr virus, adeno-associated viral (AAV) promoters, such as the p5 promoter, metallothionein promoters (e.g., the sheep metallothionein promoter or the mouse metallothionein promoter (see, e.g., Palmiter et al. (1983) *Science* 222:809-814), the human ubiquitin C promoter, *E. coli* promoters, such as the lac and trp promoters, phage lambda PL promoter, and other promoters known to control expression of genes in prokaryotic or eukaryotic cells (either directly in the cell or in viruses which infect the cell). Promoters that exhibit strong constitutive baseline expression in mammals, particularly humans, such as cytomegalovirus (CMV) promoters, such as the CMV immediate-early promoter (described in, for example, U.S. Pat. No. 5,168,062), and promoters having substantial sequence identity with such a promoter, are particularly preferred. Also preferred are recombinant promoters having novel or enhanced properties, such as those described in PCT Application Int'l Publ. No. WO 02/00897.

The promoter can have any suitable mechanism of action. Thus, the promoter can be, for example, an "inducible" promoter, (e.g., a growth hormone promoter, metallothionein promoter, heat shock protein promoter, E1B promoter, hypoxia induced promoter, radiation inducible promoter, or adenoviral MLP promoter and tripartite leader), an inducible-repressible promoter, a developmental stage-related promoter (e.g., a globin gene promoter), cell-specific, or tissue specific promoter (e.g., a smooth muscle cell α-actin promoter, myosin light-chain 1 A promoter, or vascular endothelial cadherin promoter). Suitable inducible promoters include ecdysone and ecdysone-analog-inducible promoters (ecdysone-analog-inducible promoters are commercially available through Stratagene (LaJolla Calif.)). Other suitable commercially available inducible promoter systems include the inducible Tet-Off or Tet-on systems (Clontech, Palo Alto, Calif.). The inducible promoter can be any promoter that is up- and/or down-regulated in response to an appropriate signal. Additional inducible promoters include arabinose-inducible promoters, a steroid-inducible promoters (e.g., a glucocorticoid-inducible promoters), as well as pH, stress, and heat-inducible promoters.

The promoter can be, and often is, a host-native promoter, or a promoter derived from a virus that infects a particular host (e.g., a human beta actin promoter, human EF1α promoter, or a promoter derived from a human AAV operably linked to the nucleic acid can be preferred), particularly where strict avoidance of gene expression silencing due to host immunological reactions to sequences that are not regularly present in the host is of concern. The polynucleotide also or alternatively can include a bi-directional promoter system (as described in, e.g., U.S. Pat. No. 5,017,478) linked to multiple genes of interest (e.g., multiple fusion protein encoding genes).

The nucleic acid also can be operably linked to a modified or chimeric promoter sequence. The promoter sequence is "chimeric" in that it comprises at least two nucleic acid sequence portions obtained from, derived from, or based upon at least two different sources (e.g., two different regions of an organism's genome, two different organisms, or an organism combined with a synthetic sequence). Suitable promoters also include recombinant, mutated, or recursively recombined (e.g., shuffled) promoters. Minimal promoter elements, consisting essentially of a particular TATA-associated sequence, can, for example, be used alone or in combination with additional promoter elements. TATA-less promoters also can be suitable in some contexts. The promoter and/or other expression control sequences can include one or more regulatory elements have been deleted, modified, or inactivated. Preferred promoters include the promoters described in Int'l Patent Application WO 02/00897, one or more of which can be incorporated into and/or used with nucleic acids and vectors of the invention. Other shuffled and/or recombinant promoters also can be usefully incorporated into and used in the nucleic acids and vectors of the invention, e.g., to facilitate polypeptide expression.

Other suitable promoters and principles related to the selection, use, and construction of suitable promoters are provided in, e.g., Werner (1999) *Mamm Genome* 10(2):168-75, Walther et al. (1996) *J Mol Med* 74(7):379-92, Novina (1996) *Trends Genet* 12(9):351-55, Hart (1996) *Semin Oncol* 23(1):154-58, Gralla (1996) *Curr Opin Genet Dev* 6(5):526-30, Fassler et al. (1996) *Methods Enzymol* 273:3-29, Ayoubi et al (1996), 10(4) *FASEB J* 10(4):453-60, Goldsteine et al. (1995) *Biotechnol Annu Rev* 1:105-28, Azizkhan et al (1993) *Crit Rev Eukaryot Gene Expr* 3(4):229-54, Dynan (1989) *Cell* 58(1):1-4, Levine (1989) *Cell* 59(3):405-8, and Berk et al (1986) *Annu Rev Genet* 20:45-79, as well as U.S. Pat. No. 6,194,191. Other suitable promoters can be identified by use of the Eukaryotic Promoter Database (release 68) (presently available at http://www.epd.isb-sib.ch/) and other, similar, databases, such as the Transcription Regulatory Regions Database (TRRD) (version 4.1) (available at http://www.bionet.nsc.ru/trrd/) and the transcription factor database (TRANSFAC) (available at http://transfac.gbf.de/TRANSFAC/index.html).

As an alternative to a promoter, particularly in RNA vectors and constructs, the nucleic acid sequence and/or vector can comprise one or more internal ribosome entry sites (IRESs), IRES-encoding sequences, or RNA sequence enhancers (Kozak consensus sequence analogs), such as the tobacco mosaic virus omega prime sequence.

The invention also provides a polynucleotide (or vector) that also or alternatively comprises an upstream activator sequence (UAS), such as a Gal4 activator sequence (as described in, e.g., U.S. Pat. No. 6,133,028) or other suitable upstream regulatory sequence (as described in, e.g., U.S. Pat. No. 6,204,060).

In addition to an immunogenic polynucleotide sequence, a polynucleotide or vector of the invention can include any other expression control sequences (e.g., enhancers, translation termination sequences, initiation sequences, splicing control sequences, etc.). The polynucleotide may include a Kozak consensus sequence that is functional in a mammalian cell, which can be a naturally occurring or modified sequence such as the modified Kozak consensus sequences described in U.S. Pat. No. 6,107,477. The nucleic acid can include specific initiation signals that aid in efficient translation of a coding sequence and/or fragments contained in the expression vector. These signals can include, e.g., the ATG initiation codon and adjacent sequences. In cases where a coding sequence, its initiation codon and upstream sequences are inserted into the appropriate expression vector, no additional translational control signals may be needed. However, in cases where only coding sequence (e.g., a mature protein coding sequence), or a portion thereof, is inserted, exogenous nucleic acid transcriptional control signals including the ATG initiation codon must be provided. Furthermore, the initiation codon must be in the correct reading frame to ensure transcription of the entire insert. Exogenous transcriptional elements and initiation codons can be of various origins, both natural and synthetic. The efficiency of expression can enhanced by the inclusion of enhancers appropriate to the cell system in use (see, e.g., Scharf D. et al. (1994) *Results Probl Cell Differ* 20:125-62; and Bittner et al. (1987) *Methods in Enzymol* 153:516-544 for discussion). Suitable enhancers include, for example, the rous sarcoma virus (RSV) enhancer and the RTE enhancers described in U.S. Pat. No. 6,225,082. Initiation signals including the ATG initiation codon and adjacent sequences are desirably incorporated in the polynucleotide. In cases where a polynucleotide sequence, its initiation codon and upstream sequences are inserted into the appropriate expression vector, no additional translational control signals may be needed. However, in cases where only coding sequence (e.g., a mature protein coding sequence), or a portion thereof, is inserted, exogenous nucleic acid transcriptional control signals including the ATG initiation codon are to be provided. The initiation codon must be in the correct reading frame to ensure transcription of the entire insert. Exogenous transcriptional elements and initiation codons can be of various origins, both natural and synthetic. The efficiency of expression can enhanced by the inclusion of enhancers appropriate to the cell system in use (see, e.g., Scharf D. et al. (1994) *Results Probl Cell Differ* 20:125-62; and Bittner et al. (1987) *Meth in Enzymol* 153:516-544).

A nucleic acid of the invention (e.g., DNA) may also comprise a ribosome binding site for translation initiation and a transcription-terminating region. A suitable transcription-terminating region is, for example, a polyadenylation sequence that facilitates cleavage and polyadenylation of the RNA transcript produced from the DNA nucleic acid. Any suitable polyadenylation sequence can be used, including a synthetic optimized sequence, as well as the polyadenylation sequence of BGH (Bovine Growth Hormone), human growth hormone gene, polyoma virus, TK (Thymidine Kinase), EBV (Epstein Barr Virus), rabbit beta globin, and the papillomaviruses, including human papillomaviruses and BPV (Bovine Papilloma Virus). Preferred polyadenylation (polyA) sequences include the SV40 (human Sarcoma Virus-40) polyadenylation sequence and the BGH polyA sequence, which is particularly preferred. Such polyA sequences are described in, e.g., Goodwin et al. (1998) *Nucleic Acids Res* 26(12):2891-8, Schek et al. (1992) *Mol Cell Biol* 12(12):5386-93, and van den Hoff et al. (1993) *Nucleic Acids Res* 21(21):4987-8. Additional principles related to selection of appropriate polyadenylation sequences are described in, e.g., Levitt et al. (1989) *Genes Dev* 1989 3(7):1019-1025, Jacob et al. (1990) *Crit Rev Eukaryot Gene Expr* 1(1):49-59, Chen et al. (1995) *Nucleic Acids Res* 23(14):2614-2620, Moreira et al. (1995) *EMBO J* 14(15):3809-3819, Carswell et al. (1989) *Mol Cell Biol* 1989 9(10):4248-4258.

The polynucleotide can further comprise site-specific recombination sites, which can be used to modulate transcription of the polynucleotide, as described in, e.g., U.S. Pat. Nos. 4,959,317, 5,801,030 and 6,063,627, European Patent Application 0 987 326 and International Patent Application WO 97/09439.

The invention further provides a nucleic acid of the invention that further comprises one or more immunostimulatory oligonucleotide sequences, e.g., a sequence according to the sequence pattern $N_1CGN_2)_x$, wherein $N_1$ is, 5' to 3', any two purines, any purine and a guanine, or any three nucleotides; $N_2$ is, 5' to 3', any two purines, any guanine and any purine, or any three nucleotides; and x is any number greater than 0 or 1. Immunomodulatory sequences are known in the art, and described in, e.g., Wagner et al. (2000) *Springer Semin Immunopathol* 22(1-2):147-52, Van Uden et al. (2000) *Springer Semin Immunopathol* 22(1-2):1-9, and Pisetsky (1999) *Immunol Res* 19(1):35-46, as well as U.S. Pat. Nos. 6,207, 646, 6,194,388, 6,008,200, 6,239,116, and 6,218,371. The immunostimulatory oligonucleotide sequence(s) may be unmethylated. In another aspect, the invention provides a nucleic acid that comprises a polynucleotide sequence that encodes one or more recombinant polypeptides of the invention and further comprises at least one polynucleotide sequence that encodes at least one immunostimulatory sequence as described herein. Alternatively, the immunostimulatory oligonucleotide sequence is expressed from a second polynucleotide sequence that is separate from (e.g., on a separate or second vector) the first polynucleotide sequence encoding the recombinant polypeptide of the invention In another aspect, the invention provides a nucleic acid that comprises a polynucleotide sequence that encodes one or more recombinant polypeptides of the invention and further comprises at least one polynucleotide sequence that encodes at least one protein adjuvant. Alternatively, the protein adjuvant is expressed from a second polynucleotide sequence that is separate from (e.g., on a separate or second vector) the first polynucleotide sequence encoding the recombinant polypeptide of the invention. Preferably, the adjuvant is a cytokine that promotes the immune response induced by at least immunogenic recombinant polypeptide of the invention. Preferably, the cytokine is a granulocyte macrophage colony stimulating factor (a GM-CSF, e.g., a human GM-CSF) an interferon (e.g., human interferon (IFN) alpha, IFN-beta, IFN-gamma), or a peptide comprising an amino acid sequence that is at least substantially identical (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% or more sequence identity) to the sequence of at least one such cytokine. Genes encoding such factors are known. Human GM-CSF sequences are described in, e.g., Wong et al. (1985) *Science* 228:810, Cantrell et al. (1985) *Proc Natl Acad Sci* 82:6250, and Kawasaki et al. (1985) *Science* 230:291. Desirably, in one embodiment, such a nucleic acid expresses an amount of GM-CSF or a functional analog thereof that detectably stimulates the mobilization and differentiation of dendritic cells (DCs) and/or T-cells, increases antigen presentation, and/or increases monocytes activity, such that the immune response induced by the immunogenic amino acid sequence is increased. Suitable interferon genes, such as IFN-gamma genes also are known (see, e.g., Taya et al. (1982), *Embo J* 1:953-958, Cerretti et al. (1986) *J Immunol* 136(12): 4561, and Wang et al. (1992) *Sci China B* 35(1):84-91). Desirably, the IFN, such as the IFN-gamma, is expressed from the nucleic acid in an amount that increases the immune response of the immunogenic amino acid sequence (e.g., by enhancing a T cell immune response induced by the immunogenic amino acid sequence). Advantageous IFN-homologs and IFN-related molecules that can be co-expressed or co-administered with the polynucleotide and/or polypeptide of the invention are described in, e.g., International Patent Applications WO 01/25438 and WO 01/36001. Co-administration (which herein includes both simultaneous and serial administration) of about 5 to about 10 µg of a GM-CSF-encoding plasmid with from about 5 to about 50 µg of a plasmid encoding one of the polypeptides of the invention is expected to be effective for enhancing the antibody response in a mouse model.

In another aspect, a nucleic acid of the invention comprises a T7 RNA polymerase promoter operably linked to the nucleic acid sequence, facilitating the synthesis of single stranded RNAs from the nucleic acid sequence. T7 and T7-derived sequences are known as are exemplary expression systems using T7 (see, e.g., Tabor and Richardson (1986) *Proc Natl Acad Sci USA* 82: 1074, Studier and Moffat (1986) *J Mol Biol* 189:113, and Davanloo et al. (1964) *Proc Natl Acad Sci USA* 81:2035). In one aspect, for example, nucleic acids comprising a T7 RNA polymerase and a polynucleotide sequence encoding at least one recombinant polypeptide of the invention are provide. Furthermore, a nucleic acid of the invention can comprise an origin of replication useful for propagation in a microorganism. The bacterial origin of replication (Ori) utilized is preferably one that does not adversely affect gene expression in mammalian cells. Examples of useful origin of replication sequences include the f1 phage ori, RK2 oriV, pUC ori, and the pSC101 ori. Preferred original of replication sequences include the ColEI ori and the p15 (available from plasmid pACYC177, New England Biolab, Inc.), alternatively another low copy ori sequence (similar to p15) can be desirable in some contexts. The nucleic acid in this respect desirably acts as a shuttle vector, able to replicate and/or be expressed (desirably both—such vectors capable of expression can be referred to as "expression vectors") in both eukaryotic and prokaryotic hosts (e.g., a vector comprising an origin of replication sequences recognized in both eukaryotes and prokaryotes).

A polynucleotide of the invention preferably is positioned in and/or administered in the form of a suitable delivery vehicle (i.e., a vector). The vector can be any suitable vector, including chromosomal, non-chromosomal, and synthetic nucleic acid vectors (a nucleic acid sequence comprising the above described expression cassette elements (expression control and other nucleic acid associated sequences)). Examples of such vectors include derivatives of SV40, bacterial plasmids, phage DNA, baculovirus, yeast plasmids, vectors derived from combinations of plasmids and phage DNA, and viral nucleic acid (RNA or DNA) vectors. See, e.g., FIGS. 1 and 2.

In one aspect, the nucleic acid is be administered in a naked DNA or RNA vector, including, for example, a linear expression element (as described in, e.g., Sykes and Johnston (1997) *Nat Biotech* 17:355-59), a compacted nucleic acid vector (as described in, e.g., U.S. Pat. No. 6,077,835 and/or International Patent Application WO 00/70087), a plasmid vector such as pBR322, pUC 19/18, or pUC 118/119, a "midge" minimal-sized nucleic acid vector (as described in, e.g., Schakowski et al. (2001) *Mol Ther* 3:793-800) or as a precipitated nucleic acid vector construct, such as a $CaPO_4$ precipitated construct (as described in, e.g., International Patent Application WO 00/46147, Benvenisty and Reshef (1986) *Proc Natl Acad Sci USA* 83:9551-55, Wigler et al. (1978), *Cell* 14:725, and Coraro and Pearson (1981) *Somatic Cell Genetics* 7:603). Nucleotide vectors and the usage thereof are known in the art (see, e.g., U.S. Pat. Nos. 5,589,466 and 5,973,972).

The vector can be an expression vector that is suitable for expression in a bacterial system. Any vector for use in a bacterial host can be utilized. Suitable vectors include, for example, vectors which direct high level expression of fusion proteins that are readily purified (e.g., multifunctional *E. coli* cloning and expression vectors such as BLUESCRIPT (Stratagene), pIN vectors (Van Heeke & Schuster, *J Biol Chem* 264:5503-5509 (1989); pET vectors (Novagen, Madison Wis.); and the like).

The expression vector also or alternatively can be a vector suitable for expression in a yeast system. Any vector suitable for expression in a yeast system can be employed. Suitable vectors for use in, e.g., *Saccharomyces cerevisiae* include, for example, vectors comprising constitutive or inducible promoters such as alpha factor, alcohol oxidase and PGH (reviewed in: Ausubel, supra, Berger, supra, and Grant et al. *Methods in Enzymol* 153: 516-544 (1987)).

The expression vector can be propagated in a host cell. The host cell can be a eukaryotic cell, such as a mammalian cell, a yeast cell, or a plant cell, or the host cell can be a prokaryotic cell, such as a bacterial cell. Introduction of the construct into the host cell can be effected by calcium phosphate transfection, DEAE-Dextran mediated transfection, electroporation, gene or vaccine gun, injection, or other common techniques (see, e.g., Davis et al., BASIC METHODS IN MOLECULAR BIOLOGY (1986) for a description of in vivo, ex vivo, and in vitro methods).

The nucleic acids and nucleic acid vectors of the invention can further comprise non-naturally occurring nucleotides and nucleotide sequences. Modifications to recombinant nucleic acid sequences of the invention can include making at least a portion or fragment of the recombinant nucleic acid sequence (e.g., a flaviviral antigen-encoding polynucleotide sequence) comprise a phosphorothioate backbone, incorporating at least one synthetic nucleotide analog in place of or in addition to the naturally occurring nucleotides in the nucleic acid sequence, and the addition of bases other than guanine, adenine, uracil, thymine, and cytosine, or the uses of such non-normally occurring bases in such a sequence. Such modifications can be associated with longer half-life, and thus can be desirable in nucleic acids vectors of the invention. Thus, in one aspect, the invention provides recombinant nucleic acids and nucleic acid vectors comprising at least one of the aforementioned modifications, or any suitable combination thereof, wherein the nucleic acid persists longer in a mammalian host than a substantially identical nucleic acid without such a modification or modifications.

The expression vector can also comprises nucleotides encoding a secretion/localization sequence, which targets polypeptide expression to a desired cellular compartment, membrane, or organelle, or which directs polypeptide secretion to the periplasmic space or into the cell culture media. Such sequences are known in the art, and include secretion leader or signal peptides, organelle targeting sequences (e.g., nuclear localization sequences, ER retention signals, mitochondrial transit sequences, chloroplast transit sequences), membrane localization/anchor sequences (e.g., stop transfer sequences, GPI anchor sequences), and the like.

In addition, the expression vectors of the invention optionally comprise one or more selectable marker genes to provide a phenotypic trait for selection of transformed host cells, such as dihydrofolate reductase resistance, neomycin resistance, puromycin resistance, and/or blasticidin resistance for eukaryotic cell culture, or such as tetracycline or ampicillin resistance in *E. coli*.

Additional nucleic acids provided by the invention include cosmids. Any suitable cosmid vector can be used to replicate, transfer, and express the nucleic acid sequence of the invention. Typically, a cosmid comprises a bacterial ori V, an antibiotic selection marker, a cloning site, and either one or two cos sites derived from bacteriophage lambda. The cosmid can be a shuttle cosmid or mammalian cosmid, comprising a SV40 oriV and, desirably, suitable mammalian selection marker(s). Cosmid vectors are further described in, e.g., Hohn et al. (1988) *Biotechnology* 10:113-27.

The present invention also includes recombinant constructs comprising one or more of the nucleic acid sequences, including a recombinant flavivirus virus antigen-encoding polynucleotide sequence (e.g., a recombinant dengue virus antigen-encoding polynucleotide sequence), as broadly described above. The constructs comprise a vector, such as, a plasmid, a cosmid, a phage, a virus, a bacterial artificial chromosome (BAC), a yeast artificial chromosome (YAC), and the like, into which a nucleic acid sequence of the invention has been inserted, in a forward or reverse orientation.

Figure 1:
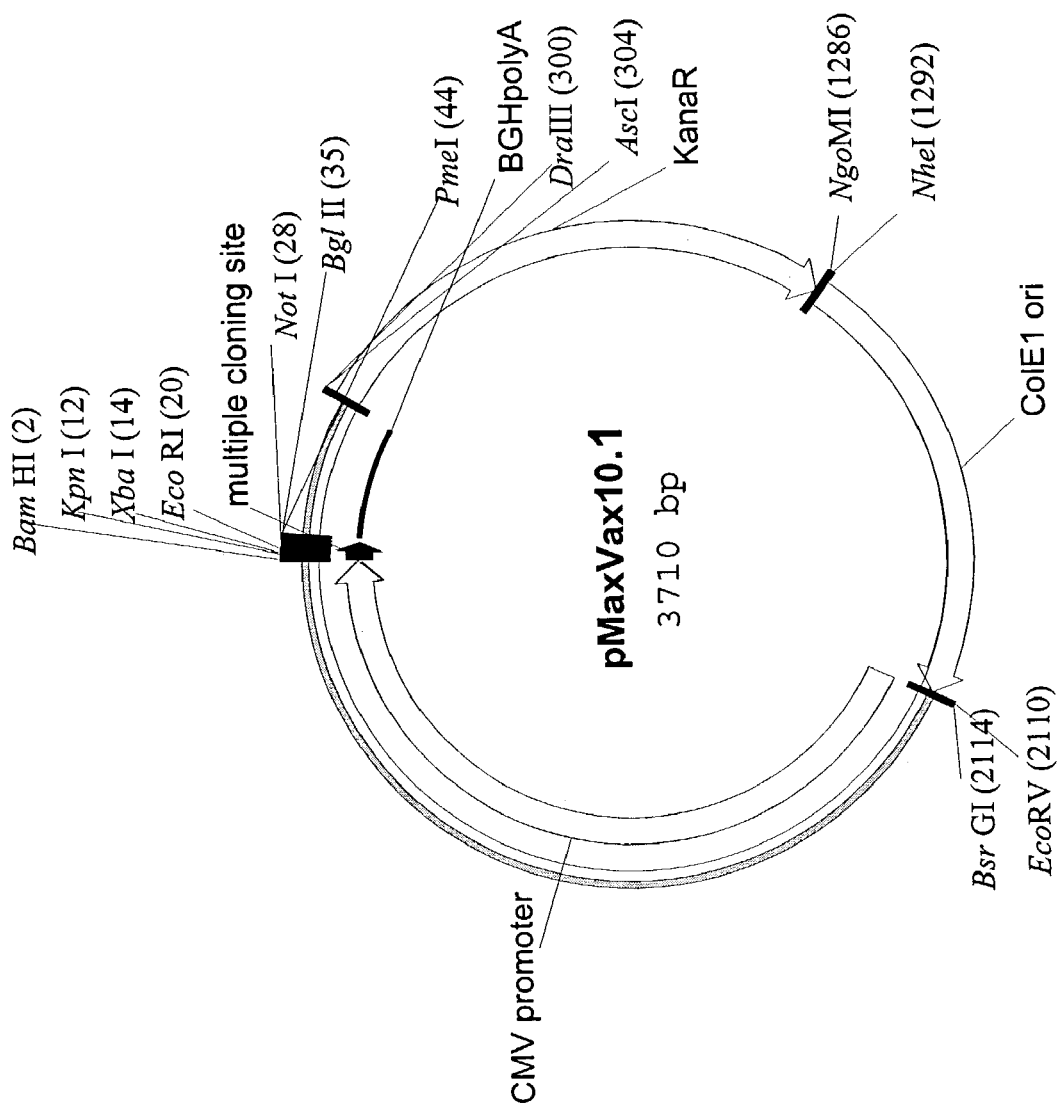
FIG. 1 is a map of a representative pMaxVax10.1 vector.
Figure 2:
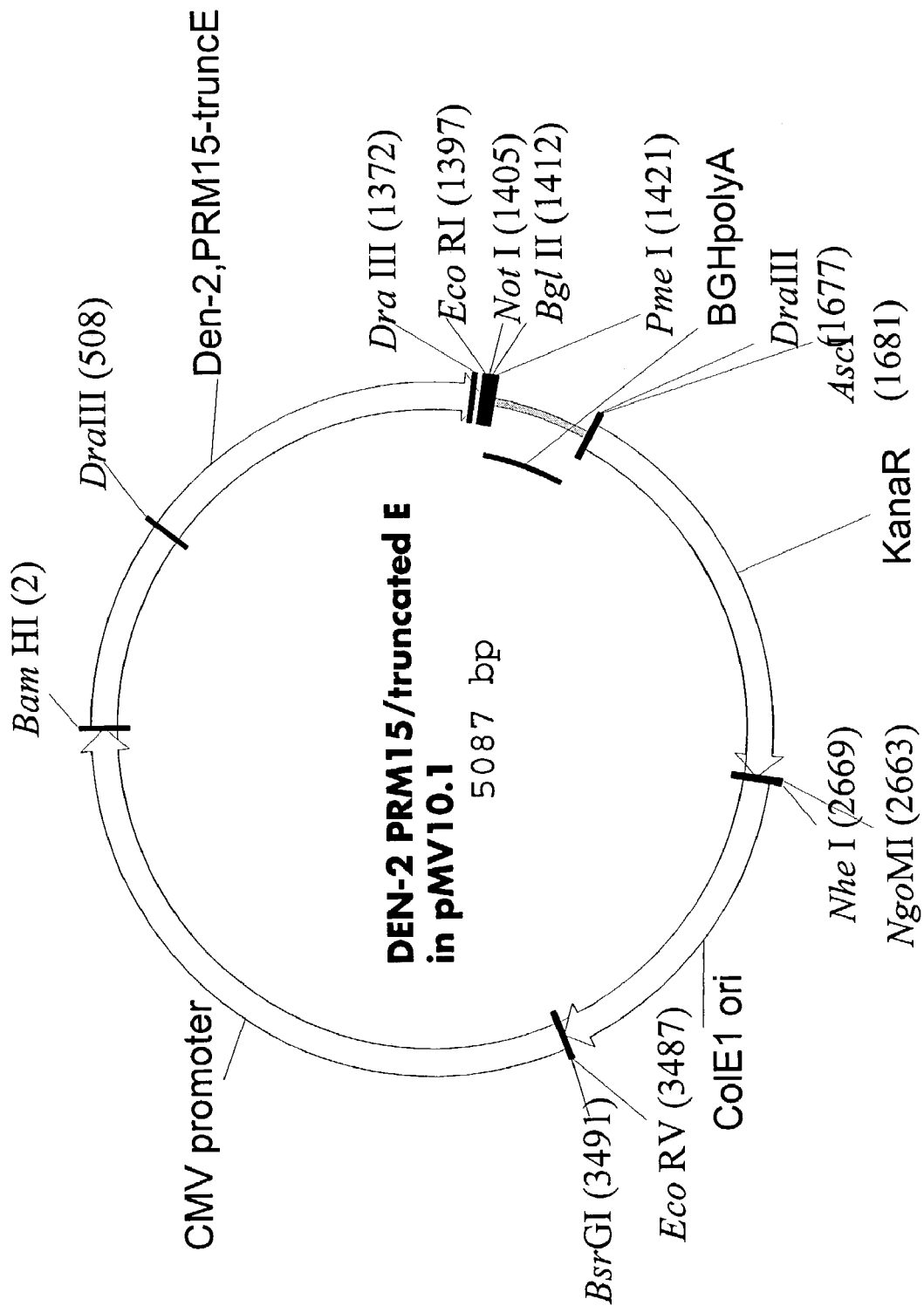
FIG. 2 illustrates an exemplary pMaxVax10.1 vector comprising an insertion of a nucleic acid that encodes a fusion protein comprising a PRM15 signal peptide/truncated E protein of a wild-type DEN-2 virus. A pMaxVax10.1 vector may be similarly constructed with a nucleic acid that encodes a fusion protein comprising a PRM15 signal peptide/truncated E protein of a WT DEN-1, DEN-3, or DEN-4 virus, or a variant thereof, in substituted for the nucleic acid sequence encoding the PRM15 signal peptide/truncated E protein of WT DEN-2 (as shown in FIG. 2). The truncated E protein of DEN-2 polyprotein comprised a polypeptide sequence comprising about 90% of the contiguous amino acid residues of the sequence of the DEN-2 E protein as measured in sequence order from the N terminus of the E protein, as explained in detail below. The term "truncated E protein" is abbreviated as "tE" or "tE protein." The invention also provides a pMaxVax10.1 vector comprising a nucleic acid of the invention that encodes a recombinant or synthetic dengue virus antigen of the invention; such nucleic acid is similarly substituted into the pMaxVax10.1 vector in the same position as the nucleic acid encoding the DEN-2 PRM15/truncated E protein polypeptide shown in FIG. 2.
Figure 3:
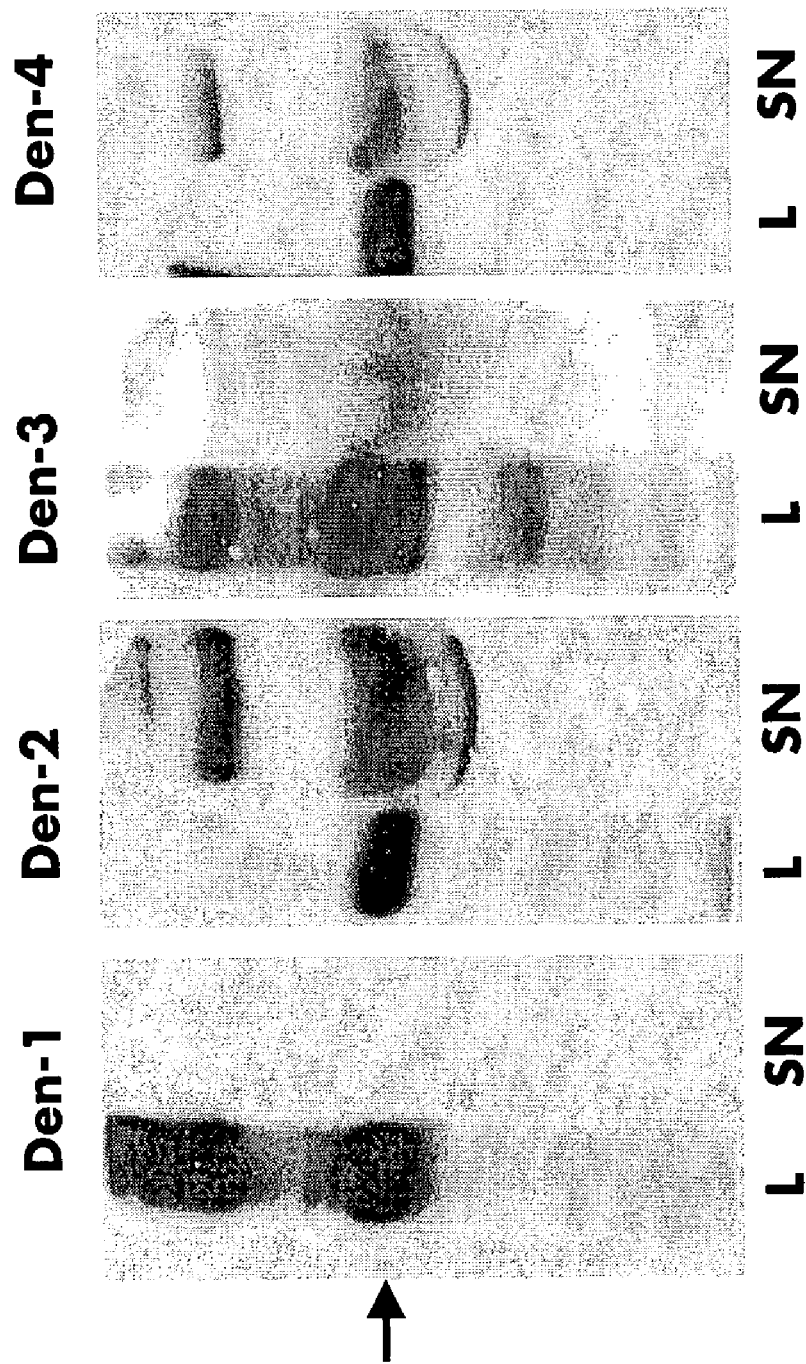
FIG. 3 displays a Western blot of dengue virus antigens, each comprising a PRM15 signal peptide/truncated (t) E protein, expressed in the lysate (L) and secreted into the medium supernatant (SN) from 293 cells transfected with one of the following vectors: pMaxVax10.1$_{Den\text{-}1PRM15/tE\ CO}$, pMaxVax10.1$_{Den\text{-}2PRM15/tE\ CO}$, pMaxVax10.1$_{Den\text{-}3PRM15/tE\ CO}$, and pMaxVax10.1$_{Den\text{-}4PRM15/tE\ CO}$. The nitrocellulose membrane bound proteins were incubated with antibodies from mouse ascitic fluid for DEN-1, DEN-2, DEN-3, and DEN-4.

In one aspect of the invention, delivery of a recombinant DNA sequence of the invention (e.g., a recombinant flavivirus antigen-encoding DNA sequence) is accomplished with a naked DNA plasmid or plasmid associated with one or more transfection-enhancing agents, as discussed further herein. The plasmid DNA vector can have any suitable combination of features. In some aspects, preferred plasmid DNA vectors comprise a strong promoter/enhancer region (e.g., human CMV, RSV, SV40, SL3-3, MMTV, or HIV LTR promoter), an effective poly(A) termination sequence, an origin of replication for plasmid product in *E. coli*, an antibiotic resistance gene as selectable marker, and a convenient cloning site (e.g., a polylinker). A particular plasmid vector for delivery of the nucleic acid of the invention in this respect is the vector pMaxVax10.1, the construction and features of which are described in Example 1 (FIGS. 1 and 2). Optionally, such a plasmid vector includes at least one immunostimulatory sequence (ISS) and/or at least one gene encoding a suitable cytokine adjuvant (e.g., a GM-CSF sequence), as further described elsewhere herein.

In other aspects, the nucleic acid of the sequence of the invention is positioned in and/or delivered to the host cell or host animal via a viral vector. Any suitable viral vector can be used in this respect, and several are known in the art. A viral vector can comprise any number of viral polynucleotides, alone or in combination with one or more viral proteins, which facilitate delivery, replication, and/or expression of the nucleic acid of the invention in a desired host cell. The viral vector can be a polynucleotide comprising all or part of a viral genome, a viral protein/nucleic acid conjugate, a virus-like particle (VLP), a vector similar to those described in U.S. Pat. No. 5,849,586 and International Patent Application WO 97/04748, or an intact virus particle comprising viral nucleic acids and the nucleic acid of the invention. A viral particle viral vector (i.e., a recombinant virus) can comprise a wild-type viral particle or a modified viral particle, particular examples of which are discussed below.

The viral vector can be a vector which requires the presence of another vector or wild-type virus for replication and/or expression (i.e., a helper-dependent virus), such as an adenoviral vector amplicon. Typically, such viral vectors consist essentially of a wild-type viral particle, or a viral particle modified in its protein and/or nucleic acid content to increase transgene capacity or aid in transfection and/or expression of the nucleic acid (examples of such vectors include the herpes virus/AAV amplicons).

Preferably, though not necessarily, the viral vector particle is derived from, is based on, comprises, or consists of, a virus that normally infects animals, preferably vertebrates, such as mammals and, especially, humans. Suitable viral vector particles in this respect, include, for example, adenoviral vector particles (including any virus of or derived from a virus of the *adenoviridae*), adeno-associated viral vector particles (AAV vector particles) or other parvoviruses and parvoviral vector particles, papillomaviral vector particles, flaviviral vectors, alphaviral vectors, herpes viral vectors, pox virus vectors, retroviral vectors, including lentiviral vectors. Examples of such viruses and viral vectors are in, e.g., FIELDS VIROLOGY, supra, Fields et al., eds., VIROLOGY Raven Press, Ltd., New York (3rd ed., 1996 and 4th ed., 2001), ENCYCLOPEDIA OF VIROLOGY, R. G. Webster et al., eds., Academic Press (2nd ed., 1999), FUNDAMENTAL VIROLOGY, Fields et al., eds., Lippincott-Raven (3rd ed., 1995), Levine, "Viruses," Scientific American Library No. 37 (1992), MEDICAL VIROLOGY, D. O. White et al., eds., Acad. Press (2nd ed. 1994), INTRODUCTION TO MODERN VIROLOGY, Dimock, N. J. et al., eds., Blackwell Scientific Publications, Ltd. (1994).

Viral vectors that can be employed with polynucleotides of the invention and the methods described herein include adenovirus and adeno-associated vectors, as in, e.g., Carter (1992) *Curr Opinion Biotech* 3:533-539 (1992) and Muzcyzka (1992) *Curr Top Microbiol Immunol* 158:97-129 (1992). Additional types and aspects of AAV vectors are described in, e.g., Buschacher et al., *Blood*, 5(8), 2499-504, Carter, *Contrib. Microbiol* 4: 85-86 (2000), Smith-Arica, *Curr. Cardiol. Rep.* 3(1):41-49 (2001), Taj, *J. Biomed. Sci.* 7(4):279-91 (2000), Vigna et al., *J. Gene Med.* 2(5):308-16 (2000), Klimatcheva et al., *Front. Biosci.* 4:D481-96 (1999), Lever et al., *Biochem. Soc. Trans.* 27(6):841-47 (1999), Snyder, *J. Gene Med.* 1(3):166-75 (1999), Gerich et al., *Knee Surg. Sports Traumatol. Arthrosc.* 5(2):118-23 (1998), and During, *Adv. Drug Deliv. Review* 27(1):83-94 (1997), and U.S. Pat. Nos. 4,797,368, 5,139,941, 5,173,414, 5,614,404, 5,658,785, 5,858,775, and 5,994,136, as well as other references discussed elsewhere herein). Adeno-associated viral vectors can be constructed and/or purified using the methods set forth, for example, in U.S. Pat. No. 4,797,368 and Laughlin et al., *Gene* 23:65-73 (1983).

Another type of viral vector that can be employed with polynucleotides and methods of the invention is a papillomaviral vector. Suitable papillomaviral vectors are known in the art and described in, e.g., Hewson (1999) *Mol Med Today* 5(1):8, Stephens (1987) *Biochem J* 248(1):1-11, and U.S. Pat. No. 5,719,054. Particularly preferred papillomaviral vectors are provided in, e.g., International Patent Application WO 99/21979.

Alphavirus vectors can be gene delivery vectors in other contexts. Alphavirus vectors are known in the art and described in, e.g., Carter (1992) *Curr Opinion Biotech* 3:533-539, Muzcyzka (1992) *Curr Top Microbiol Immunol.* 158:97-129, Schlesinger *Expert Opin Biol Ther.* 2001 March;1(2): 177-91, Polo et al. *Dev Biol (Basel).* 2000;104:181-5, Wahlfors et al. *Gene Ther.* 2000 March;7(6):472-80, Colombage et al. *Virology.* 1998 October 10;250(1):151-63, and International Patent Applications WO 01/81609, WO 00/39318, WO 01/81553, WO 95/07994, and WO 92/10578.

Another advantageous group of viral vectors are the herpes viral vectors. Examples of herpes viral vectors are described in, e.g., Lachmann et al., *Curr Opin Mol Ther* 1999 October; 1(5):622-32, Fraefel et al., *Adv Virus Res.* 2000;55:425-51, Huard et al., *Neuromuscul Disord.* 1997 July;7(5):299-313, Glorioso et al., *Annu Rev Microbiol.* 1995;49:675-710, Latchman, *Mol Biotechnol.* 1994 October; 2(2):179-95, and Frenkel et al., *Gene Ther.* 1994;1 Suppl 1:S40-6, as well as U.S. Pat. Nos. 6,261,552 and 5,599,691.

Retroviral vectors, including lentiviral vectors, also can be advantageous gene delivery vehicles in particular contexts. There are numerous retroviral vectors known in the art. Examples of retroviral vectors are described in, e.g., Miller, *Curr Top Microbiol Immunol* (1992) 158:1-24; Salmons and Gunzburg (1993) *Human Gene Therapy* 4:129-141; Miller et al. (1994) *Methods in Enzymology* 217:581-599, Weber et al., *Curr Opin Mol Ther.* 2001 October;3(5):439-53, Hu et al., *Pharmacol Rev.* 2000 December;52(4):493-511, Kim et al., *Adv Virus Res.* 2000;55:545-63, Palu et al., *Rev Med Virol.* 2000 May-June; 10(3):185-202, and Takeuchi et al., *Adv Exp Med Biol.* 2000;465:23-35, as well as U.S. Pat. Nos. 6,326, 195, 5,888,502, 5,580,766, and 5,672,510.

Adenoviral vectors also can be suitable viral vectors for gene transfer. Adenoviral vectors are well known in the art and described in, e.g., Graham et al (1995) *Mol Biotechnol* 33(3):207-220, Stephenson (1998) *Clin Diagn Virol* 10(2-3): 187-94, Jacobs (1993) *Clin Sci* (Lond). 85(2):117-22, U.S. Pat. Nos. 5,922,576, 5,965,358 and 6,168,941 and Int'l Patent Appns WO 98/22588, WO 98/56937, WO 99/15686, WO 99/54441, and WO 00/32754. Adenoviral vectors, herpes viral vectors and Sindbis viral vectors, useful in the practice of the invention, are described in, e.g., Jolly (1994) *Cancer Gene Therapy* 1:51-64, Latchman (1994) *Molec Biotechnol* 2:179-195, and Johanning et al. (1995) *Nucl Acids Res* 23:1495-1501.

Other suitable viral vectors include pox viral vectors. Examples of such vectors are discussed in, e.g., Berencsi et al., *J Infect Dis* (2001)183(8):1171-9; Rosenwirth et al., *Vaccine* 2001 Feburary 8;19(13-14):1661-70; Kittlesen et al., *J Immunol* (2000) 164(8):4204-11; Brown et al. *Gene Ther* 2000 7(19):1680-9; Kanesa-thasan et al., *Vaccine* (2000) 19(4-5)483-91; Sten (2000) *Drug* 60(2):249-71. Vaccinia virus vectors are preferred pox virus vectors. Examples of such vectors and uses thereof are provided in, e.g., Venugopal et al. (1994) *Res Vet Sci* 57(2):188-193, Moss (1994) *Dev Biol Stand* 82:55-63 (1994), Weisz et al. (1994) *Mol Cell Biol* 43:137-159, Mahr and Payne (1992) *Immunobiology* 184(2-3):126-146, Hruby (1990) *Clin Microbiol Rev* 3(2):153-170, and International Patent Applications WO 92/07944, WO 98/13500, and WO 89/08716.

Another aspect of the invention is a flaviviral vector comprising at least one recombinant nucleic acid sequence of the invention (e.g., a recombinant PRM15 or C15 signal peptide, recombinant tE polypeptide-encoding nucleic acid, full E polypeptide-encoding nucleic acid, PRM15/tE polypeptide-encoding nucleic acid, C15/full prM/full E polypeptide-encoding nucleic acid, C15/full prM/tE polypeptide-encoding nucleic acid). The nucleic acid can be positioned in any suitable portion of the flaviviral genome. For example, the nucleic acid can be inserted into or used to replace a nucleotide sequence portion of the genome, typically a nucleotide sequence portion that encodes a similar or equivalent polypeptide as does the nucleic acid. For example, a recombinant C15/full prM/full E polypeptide-encoding nucleic acid can replace all or part wild-type C15/full prM/full E-encoding sequence of the flaviviral genome. Thus, a recombinant polypeptide of the invention can be positioned in a portion of the flaviviral envelope.

In this respect, one or more nucleic acids of the invention can be incorporated into any suitable flaviviral vector. Examples of suitable vectors are described in, e.g., Bonaldo et al., *Mem Inst Oswaldo Cruz.* 2000;95 Suppl 1:215-23, Caufour et al. *Virus Res.* 2001 November 5;79(1-2):1-14, Guirakhoo et al. *J Virol.* 2001 August;75(16):7290-304, Pletnev et al. *Virology.* 2000 August. 15;274(1):26-31, Guirakhoo et al. *J Virol.* 2000 June;74(12):5477-85, and International Patent Applications WO 93/06214 and WO 01/53467. Techniques for constructing recombinant viral vectors and/or modifying known or recombinant viral vectors are disclosed in Sambrook (supra) and other referenced cited herein. Replication-deficient (RD) flaviviruses (including, e.g., RD dengue and yellow fever viruses) also can be useful as vectors or for delivery vehicles. Included is a replication-deficient flavivirus (e.g., RD dengue or YF virus) comprising at least one polypeptide of the invention in place of or in addition to the native flavivirus (e.g., dengue or YF virus) envelope protein or native flavivirus (e.g., dengue or YF virus) prM protein and envelope protein. Also contemplated is a replication-deficient flavivirus comprising at least one nucleic acid of the invention in place of or in addition to a nucleic acid segment of the WT flavivirus genome that encodes the flavivirus envelope protein or the flavivirus prM protein and envelope protein.

A dengue virus that is replication-deficient in mosquito hosts and that can be combined with the polypeptide of the invention (via the nucleic acid of the invention) to serve as a vaccine is described in International Patent Application WO 00/14245. The use of one or more viruses and/or viral vectors of the *Flaviviridae* family of viruses or, including, e.g., but not limited to, a yellow fever virus or yellow fever virus vector (see, e.g., Guirakhoo et al., *J. Virol.* 75(16):7290-304 (2001)) to deliver at least one nucleic acid and/or at least one polypeptide of the invention is believed to be advantageous.

In another aspect, the invention provides a chimeric virus comprising a virus of the *Flaviviridae* family of viruses (such as, e.g., a yellow fever virus, such as, e.g., yellow fever 17D or the like) in which the complete E protein-encoding nucleic acid sequence(s) or fragment(s) thereof (e.g., a nucleic acid sequence encoding a tE protein) of the virus of the *Flaviviridae* family (e.g., yellow fever virus) is substituted with a corresponding recombinant E-protein-encoding nucleic acid sequence of the invention (or a recombinant tE-polypeptide-encoding nucleic acid). Such chimeric virus may be an attenuated virus of the *Flaviviridae* family (e.g., an attenuated yellow fever virus). The invention also includes a chimeric virus of the *Flaviviridae* family of viruses (e.g., yellow fever virus) in which the E protein-encoding gene(s) of the virus of the *Flaviviridae* family (e.g., yellow fever virus) (or gene encoding a truncated E protein) is substituted with a recombinant E-protein-encoding nucleotide (or recombinant tE polypeptide-encoding nucleotide) of the invention. Typically, the nucleotide length of the substituted recombinant nucleotide of the invention is substantially equivalent to that of the replaced virus nucleotide sequence. The nucleic acid sequence encoding the truncated E protein typically comprises a nucleotide segment corresponding to the gene encoding the E protein minus the nucleotide residues that encode at least about 8%, 10%, or 12% of the C-terminal amino acid residues of the E protein.

The invention also provides nucleic acids that comprise the genome of a virus of the *Flaviviridae* family (e.g., yellow fever virus genome or dengue virus genome) in which the nucleotide sequence of the genome encoding the E protein (or a truncE protein) is replaced with a recombinant nucleotide sequence of the invention that encodes a recombinant full length E protein or recombinant truncE polypeptide. Included are substituted nucleic acids (isolated from the virus) and polypeptides encoded by all such nucleic acids.

Similarly, the invention provides a chimeric virus comprising a virus of the *Flaviviridae* family of viruses (e.g., a yellow fever virus, such as yellow fever 17D, or dengue virus, such as DEN-2, DEN-3) in which a PRM15/truncated E polypeptide-encoding nucleic acid sequence of the virus of the *Flaviviridae* family (e.g., yellow fever virus) is substituted with a recombinant PRM15/tE polypeptide-encoding nucleic acid sequence of the invention. Also provided is a chimeric virus comprising a virus of the *Flaviviridae* family of viruses (such as, e.g., yellow fever 17D, DEN-2) in which a C15/full length prM/full length E-polypeptide-encoding nucleic acid sequence of the virus of the *Flaviviridae* family (e.g., yellow fever virus) is substituted with a recombinant C15/full length prM/full length E polypeptide-encoding nucleic acid sequence of the invention. In both such embodiments, the chimeric virus may be an attenuated virus of the *Flaviviridae* family (e.g., an attenuated yellow fever virus). The nucleotide length of the substituted recombinant nucleotide is usually substantially equivalent to that of the replaced virus nucleotide sequence. Also included are such substituted nucleic acids (isolated from the virus) and polypeptides encoded by all such nucleic acids.

The invention includes chimeric replication-deficient or attenuated viruses comprising a virus of the *Flaviviridae* family of viruses with one or more synthetic or recombinant polypeptides or nucleic acids of the invention. Such chimeric viruses may become replication-deficient or attenuated by incorporation of the one or more synthetic or recombinant polypeptides or nucleic acids of the invention. Methods of making replication-deficient or attenuated viruses by substituting portions of the WT flavivirus genome with synthetic or recombinant nucleic acids as described above are included.

Also included is a chimeric virus having a genome comprising a full length chimeric flavivirus genome comprising a nucleotide sequence comprising at least one first nucleic acid of the invention, said at least one first nucleic acid encoding at least one recombinant or synthetic dengue virus structural protein of the invention, wherein said at least one first nucleic acid is linked to at least one second nucleic acid encoding at least one non-structural protein of a second flavivirus, wherein the second flavivirus is not a dengue virus, and wherein the chimeric flavivirus is defined as an approximately 11-kilobase positive strand RNA virus having a genome that codes in one open reading frame for three structural proteins, capsid (C), premembrane (prM) and envelope (E), followed by seven non-structural proteins, NS1, NS2A, NS2B, NS3, NS4A, NS4B and NS5.

Any flavivirus can be modified by the incorporation of at least one nucleic acid of the invention, preferably at the nucleic acid level, using standard molecular biology techniques. Typically, in such aspects, at least a portion of the particular native prM/E-encoding nucleic acid sequences of interest (e.g., native sequence encoding tE, full E, PRM15/tE, or C15/full prM/full E polypeptide) are removed and replaced/substituted with a recombinant nucleic acid of the invention, such that a recombinant polypeptide is encoded and the flavivirus comprises a recombinant polypeptide of the invention in place of or in addition to its native prM/E-encoding sequence interest (e.g., native sequence encoding tE, full E, PRM15/tE, or C15/full prM/full E polypeptide). In one aspect, this technique is performed with non-attenuated flaviviruses by, e.g., replacing at least one nucleotide segment or portion of the native flavivirus genome (e.g., native sequence encoding tE, full E, PRM15/tE, or C15/full prM/full E polypeptide) with at least one recombinant polypeptide of the invention. Such incorporation may produce a chimeric virus that is attenuated. In another aspect, this technique is performed with flaviviruses that are already inactivated or that already comprise a proven attenuated virus genome. In some particular aspects, the attenuated flavivirus is an attenuated dengue virus, e.g., PDK 53, examples of which are described in, e.g., Bhhamarapravati et al., *Vaccine* 18:44-47 (2000), Men et al., *J. Virol.* 70(6):3930-37 (1996), Kanesa-thasan, Kanesa-thasan et al., *Vaccine* 19:3179-88 (20001) and International Patent Applications WO 00/57910, WO 00/57909, WO 00/57908, and WO 00/57904. Low pathogenicity and/or low side-effect attenuated dengue viruses derived from dengue-2 virus strains may be among those used. In one aspect, a dose of about 50 or about $1 \times 10^2$ plaque forming units (pfu) or focus forming units (ffu) to about $6 \times 10^{10}$ pfu or to about $7 \times 10^{10}$ pfu (e.g., about $3.5 \times 10^{10}$ pfu to about $4.5 \times 10^{10}$ pfu) of such a recombinant (e.g., attenuated) flaviviral vector or virus provides an amount effective to induce an immune response in a suitable subject (e.g., an animal, such as a mammal, including a human) to at least one flavivirus (e.g., dengue virus of at least one serotype). Such a dose is administered to the subject by any route described herein (e.g., subcutaneous injection). In another aspect, a dose of about $1 \times 10^2$ to about $5 \times 10^4$ pfu, about $1 \times 10^2$ to about $1.5 \times 10^4$ pfu, about $1 \times 10^2$ to about $1 \times 10^3$ pfu, or about $1 \times 10^3$ to about $1 \times 10^6$ pfu or about $1 \times 10^8$ pfu of a recombinant (e.g., attenuated) flaviviral vector or virus (e.g., a recombinant attenuated dengue virus) is effective to induce an immune response to at least one flavivirus (e.g., at least one dengue virus of at least one serotype upon administration to the subject. Alternatively, the minimum lethal dosage ($MLD_{50}$) equivalent to any above described pfu dosage can be administered to the subject.

The toxicity and therapeutic efficacy of vectors or viruses that include recombinant molecules of the invention are determined using standard pharmaceutical procedures in cell cultures or experimental animals. One can determine the $MLD_{50}$ (the minimum dose lethal to 50% of the population) and/or the $ED_{50}$ (the dose therapeutically effective in 50% of the population) using procedures presented herein and those otherwise known in the art. See also S. Plotkin and W. Orenstein, VACCINES (W. B. Saunders Co. 1999 3d ed.) for suggested doses for known flavivirus vaccines, including yellow fever virus 17D vaccine. Nucleic acids, polypeptides, proteins, fusion proteins, transduced cells and other formulations of the present invention can be administered in an amount determined, e.g., by the $MLD_{50}$ of the formulation, and the side-effects thereof at various concentrations, as applied to the mass and overall health of the patient. Thus, for example, the invention provides a method of inducing an immune response by administering a dose equal or greater to the $ED_{50}$ of a pharmaceutically acceptable composition comprising a population of recombinant yellow fever virus particles (e.g., 17D vaccine variants) that comprise a recombinant polypeptide or nucleic acid of the invention. Administration can be accomplished via single dose or divided doses (either by co-administration, serial administration, or combinations thereof). Administration techniques and protocols are described in, e.g., Plotkin (VACCINES) supra and other references cited herein. In a related sense, techniques for assessing dosage of the nucleic acid, polypeptide, vector, and cell compositions effective for inducing immunity are described in, e.g., European Patent Application 1 156 333 and references cited therein.

In some aspects, it is preferred that the virus vector is attenuated or replication-deficient in a host cell or host. AAV vectors, which are naturally replication-deficient in the absence of complementing adenoviruses or at least adenovirus gene products (provided by, e.g., a helper virus, plasmid, or complementation cell), are preferred in this respect. By "replication-deficient" is meant that the viral vector comprises a genome that lacks at least one replication-essential gene function. A deficiency in a gene, gene function, or gene or genomic region, as used herein, is defined as a deletion of sufficient genetic material of the viral genome to impair or obliterate the function of the gene whose nucleic acid sequence was deleted in whole or in part. Replication-essential gene functions are those gene functions that are required for replication (i.e., propagation) of a replication-deficient viral vector. The essential gene functions of the viral vector particle vary with the type of viral vector particle at issue. Examples of replication-deficient viral vector particles are described in, e.g., Marconi et al., *Proc. Natl. Acad. Sci. USA*, 93(21), 11319-20 (1996), Johnson and Friedmann, *Methods Cell Biol*., 43 (pt. A), 211-30 (1994), Timiryasova et al., *J. Gene Med*., 3(5), 468-77 (2001), Burton et al., *Stem Cells*, 19(5), 358-77 (2001), Kim et al., *Virology*, 282(1), 154-67 (2001), Jones et al., *Virology*, 278(1), 137-50 (2000), Gill et al., *J. Med. Virol*., 62(2), 127-39 (2000), Chen and Engleman, *J. Virol*., 74(17), 8188-93 (2000), Marconi et al., *Gene Ther*., 6(5), 904-12 (1999), Krisky et al., *Gene Ther*., 5(11), 1517-30 (1998), Bieniasz et al., *Virology*, 235(1), 65-72 (1997), Strayer et al., *Biotechniques*, 22(3), 447-50 (1997), Wyatt et al., *Vaccine*, 14(15), 1451-8 (1996), and Penciolelli et al., *J. Virol*., 61(2), 579-83 (1987). Other replication-deficient vectors are based on simple MuLV vectors. See, e.g., Miller et al. (1990) *Mol Cell Biol* 10:4239 (1990); Kolberg (1992) *J NIH Res* 4:43, and Cornetta et al. (1991) *Hum Gene Ther* 2:215).

The basic construction of recombinant viral vectors is well understood in the art and involves using standard molecular biological techniques such as those described in, e.g., Sambrook et al., MOLECULAR CLONING: A LABORATORY MANUAL (Cold Spring Harbor Press 1989) and the third edition thereof (2001), Ausubel et al., CURRENT PROTOCOLS IN MOLECULAR BIOLOGY (Wiley Interscience Publishers 1995), and Watson et al., RECOMBINANT DNA, (2d ed.), and several of the other references mentioned herein, all of which are incorporated herein by reference in their entirety for all purposes. For example, adenoviral vectors can be constructed and/or purified using the methods set forth, for example, in Graham et al., *Mol. Biotechnol*., 33(3), 207-220 (1995), U.S. Pat. No. 5,965,358, Donthine et al., *Gene Ther*., 7(20), 1707-14 (2000), and other references described herein. Adeno-associated viral vectors can be constructed and/or purified using the methods set forth, for example, in U.S. Pat. No. 4,797,368 and Laughlin et al., Gene, 23, 65-73 (1983). Similar techniques are known in the art with respect to other viral vectors, particularly with respect to herpes viral vectors (see e.g., Lachman et al., *Curr. Opin. Mol. Ther*., 1(5), 622-32 (1999)), lentiviral vectors, and other retroviral vectors. In general, the viral vector comprises an insertion of the nucleic acid (for example, a wild-type adenoviral vector can comprise an insertion of up to 3 KB without deletion), or, more typically, comprises one or more deletions of the virus genome to accommodate insertion of the nucleic acid and additional nucleic acids, as desired, and to prevent replication in host cells.

In one aspect, the viral vector desirably is a targeted viral vector, comprising a restricted or expanded tropism as compared to a wild-type viral particle of similar type. Targeting is typically accomplished by modification of capsid and/or envelope proteins of the virus particle. Examples of targeted virus vectors and related principles are described in, e.g., International Patent Applications WO 92/06180, WO 94/10323, WO 97/38723, and WO 01/28569, and WO 00/11201, Engelstadter et al., Gene Ther., 8(15), 1202-6 (2001), van Beusechem et al., Gene Ther., 7(22), 1940-6 (2000), Boerger et al., Proc. Natl. Acad. Sci. USA, 96(17), 9867-72 (1999), Bartlett et al., Nat. Biotechnol., 17(2), 181-6 (1999), Girod et al., Nat. Med., 5(9), 1052-56 (as modified by the erratum in Nat. Med., 5(12), 1438) (1999), J Gene Med. 1999 September-October;1(5):300-11, Karavanas et al. Crit Rev Oncol Hematol. 1998 June; 28(1):7-30, Wickham et al., J. Virol., 71(10), 7663-9 (1997), Cripe et al., Cancer Res., 61(7), 2953-60 (2001), van Deutekom et al., J. Gene Med., 1(6), 393-9 (1999), McDonald et al., J. Gene Med., 1(2), 103-10 (1999), Peng, Curr Opin Biotechnol. 1999 October; 10(5):454-7, Staba et al., Cancer Gene Ther., 7(1), 13-9 (2000), Kibbe et al., Arch. Surg., 135(2), 191-7 (2000), Harari et al., Gene Ther., 6(5), 801-7 (2000), and Bouri et al., Hum Gene Ther., 10(10), 1633-40 (1999), and Laquerre et al., J. Virol., 72(12), 9683-97 (1997), Buchholz Curr Opin Mol Ther. 1999 October;1(5):613-21, U.S. Pat. Nos. 6,261,554, 5,962,274, 5,695,991, and 6,251,654, and European Patent Appns 1 002 119 and 1 038 967. Particular targeted vectors and techniques for producing such vectors are provided in Int'l Patent Appn WO 99/23107.

The viral vector particle can be a chimeric viral vector particle. Examples of chimeric viral vector particles are described in, e.g., Reynolds et al., Mol. Med. Today, 5(1), 25-31 (1999), Boursnell et al., Gene, 13, 311-317 (1991), Dobbe et al., Virology, 288(2), 283-94 (2001), Grene et al., AIDS Res. Human. Retroviruses, 13(1), 41-51 (1997), Reimann et al., J. Virol., 70(10), 6922-8 (1996), Li et al., J. Virol., 67(11), 6659-66 (1993), Dong et al., J. Virol., 66(12), 7374-82 (1992), Wahlfors, Hum Gene Ther. May 1, 1999;10

(7):1197-206, Reynolds et al., Mol. Med. Today, 5(1), 25-31 (1999), Boursnell et al., Gene, 13, 311-317 (1991).and U.S. Pat. Nos. 5,877,011, 6,183,753, 6,146,643, and 6,025,341.

Non-viral vectors of the invention also can be associated with molecules that target the vector to a particular region in the host (e.g., a particular organ, tissue, and/or cell type). For example, a nucleotide can be conjugated to a targeting protein, such as a viral protein that binds a receptor or a protein that binds a receptor of a particular target (e.g., by a modification of the techniques provided in Wu and Wu, J. Biol. Chem., 263(29), 14621-24 (1988)). Targeted cationic lipid compositions also are known in the art (see, e.g., U.S. Pat. No. 6,120,799). Other techniques for targeting genetic constructs are provided in International Patent Application WO 99/41402.

In a further embodiment, the present invention provides host cells comprising one or more of any of the above-described nucleic acids, vectors, polypeptides, antibodies, fusion proteins, or other constructs of the invention, or any combination of one or more of these. The host cell can be a eukaryotic cell, such as a mammalian cell, a yeast cell, or a plant cell, or the host cell can be a prokaryotic cell, such as a bacterial cell. Introduction of the construct into the host cell can be effected by calcium phosphate transfection, DEAE-Dextran mediated transfection, electroporation, gene or vaccine gun, injection, or other common techniques (see, e.g., Davis, L., Dibner, M., and Battey, I. (1986) BASIC METHODS IN MOLECULAR BIOLOGY) for in vivo, ex vivo, and in vitro methods.

A host cell strain is optionally chosen for its ability to modulate the expression of the inserted sequences or to process the expressed protein in the desired fashion. Such modifications of the protein include, but are not limited to, acetylation, carboxylation, glycosylation, phosphorylation, lipidation and acylation. Post-translational processing that cleaves a "pre" or a "prepro" form of the protein may also be important for correct insertion, folding and/or function. Different host cells such as E. coli, Bacillus sp., yeast or mammalian cells such as CHO, HeLa, BHK, MDCK, HEK 293, WI38, etc. have specific cellular machinery and characteristic mechanisms for such post-translational activities and may be chosen to ensure the correct modification and processing of the introduced foreign protein.

A nucleic acid of the invention can be inserted into an appropriate host cell (in culture or in a host organism) to permit the host to express the protein. Any suitable host cell can be used transformed/transduced by the nucleic acids of the invention. Examples of appropriate expression hosts include: bacterial cells, such as E. coli, Streptomyces, Bacillus sp., and Salmonella typhimurium; fungal cells, such as Saccharomyces cerevisiae, Pichia pastoris, and Neurospora crassa; insect cells such as Drosophila and Spodoptera frugiperda; mammalian cells such as Vero cells, HeLa cells, CHO cells, COS cells, WI38 cells, N1H-3T3 cells (and other fibroblast cells, such as MRC-5 cells), MDCK cells, KB cells, SW-13 cells, MCF7 cells, BHK cells, HEK-293 cells, Bowes melanoma cells, and plant cells, etc. It is understood that not all cells or cell lines need to be capable of producing fully functional polypeptides or fragments thereof; for example, antigenic fragments of the polypeptide may be produced in a bacterial or other expression system. Additional examples of suitable cells are described, for example, in U.S. Pat. No. 5,994,106 and Int'l Patent Application WO 95/34671.

The present invention also provides host cells that are transduced, transformed or transfected with vectors of the invention. A vector of the invention typically comprises a nucleic acid of the invention (e.g., recombinant PRM15 or C15 signal peptide-encoding nucleic acid, tE polypeptide-encoding nucleic acid, full E polypeptide-encoding nucleic acid, PRM15/tE polypeptide-encoding nucleic acid, C15/full prM/full E-encoding nucleic acid). Host cells are genetically engineered (e.g., transduced, transformed or transfected) with the vectors of this invention, which may be, for example, a cloning vector or an expression vector. The vector may be, for example, in the form of a plasmid, a viral particle, a phage, etc. Cells suitable for transduction and/or infection with viral vectors of the invention for production of the recombinant polypeptides of the invention and/or for replication of the viral vector of the invention include the above-described cells.

Examples of cells that have been demonstrated as suitable for packaging of viral vector particles are described in, e.g., Inoue et al., J. Virol., 72(9), 7024-31 (1998), Polo et al., Proc. Natl. Acad. Sci., 96(8), 4598-603 (1999), Farson et al., J. Gene Med., 1(3), 195-209 (1999), Sheridan et al., Mol. Ther., 2(3), 262-75 (2000), Chen et al., Gene Ther., 8(9), 697-703 (2001), and Pizzaro et al., Gene Ther., 8(10), 737-745 (2001). For replication-deficient viral vectors, such as AAV vectors, complementing cell lines, or cell lines transformed with helper viruses, or cell lines transformed with plasmids encoding essential genes, are necessary for replication of the viral vector.

The engineered host cells can be cultured in conventional nutrient media modified as appropriate for activating promoters, selecting transformants, or amplifying the gene of interest. The culture conditions, such as temperature, pH, and the like, are those previously used with the host cell selected for expression, and will be apparent to those skilled in the art and in the references cited herein, including, e.g., ANIMAL CELL TECHNOLOGY, Rhiel et al., eds., (Kluwer Academic Publishers 1999), Chaubard et al., Genetic Eng. News, 20(18) (2000), Hu et al., ASM News, 59, 65-68 (1993), Hu et al., Biotechnol. Prog., 1, 209-215 (1985), Martin et al., Biotechnol., (1987), Freshney, CULTURE OF ANIMAL CELLS: A MANUAL OF BASIC TECHNIQUE, $4^{TH}$ ED., (Wiley, 2000), Mather, INTRODUCTION TO CELL AND TISSUE CULTURE: THEORY AND TECHNIQUE, (Plenum Press, 1998), Freshney, CULTURE OF IMMORTALIZED CELLS, $3^{RD}$ ED., (John Wiley & Sons, 1996), CELL CULTURE: ESSENTIAL TECHNIQUES, Doyle et al., eds. (John Wiley & Sons 1998), and GENERAL TECHNIQUES OF CELL CULTURE, Harrison et al., eds., (Cambridge Univ. Press 1997). The nucleic acid also can be contained, replicated, and/or expressed in plant cells. Techniques related to the culture of plant cells are described in, e.g., Payne et al. (1992) PLANT CELL AND TISSUE CULTURE IN LIQUID SYSTEMS John Wiley & Sons, Inc. New York, N.Y.; Gamborg and Phillips (eds.) (1995) PLANT CELL, TISSUE AND ORGAN CULTURE: FUNDAMENTAL METHODS Springer Lab Manual, Springer-Verlag (Berlin Heidelberg N.Y.) and PLANT MOLECULAR BIOLOGY (1993) R. R. D. Croy (ed.) Bios Scientific Publishers, Oxford, U.K. ISBN 0 12 198370 6. Cell culture media in general are set forth in Atlas and Parks (eds.) THE HANDBOOK OF MICROBIOLOGICAL MEDIA (1993) CRC Press, Boca Raton, Fla.

For long-term, high-yield production of recombinant proteins, stable expression can be used. For example, cell lines that stably express a polypeptide of the invention are transduced using expression vectors which comprise viral origins of replication or endogenous expression elements and a selectable marker gene. Following the introduction of the vector, cells may be allowed to grow for 1-2 days in an enriched media before they are switched to selective media. The purpose of the selectable marker is to confer resistance to selection, and its presence allows growth and recovery of cells that successfully express the introduced sequences. For example, resistant clumps of stably transformed cells can be proliferated using tissue culture techniques appropriate to the cell type.

Host cells transformed with an expression vector and/or polynucleotide are optionally cultured under conditions suitable for the expression and recovery of the encoded protein from cell culture. The polypeptide or fragment thereof produced by such a recombinant cell may be secreted, membrane-bound, or contained intracellularly, depending on the sequence and/or the vector used. Expression vectors comprising polynucleotides encoding mature polypeptides of the invention can be designed with signal sequences that direct secretion of the mature polypeptides through a prokaryotic or eukaryotic cell membrane. Principles related to such signal sequences are discussed elsewhere herein.

Cell-free transcription/translation systems can also be employed to produce recombinant polypeptides of the invention or fragments thereof using DNAs and/or RNAs of the present invention or fragments thereof. Several such systems are commercially available. A general guide to in vitro transcription and translation protocols is found in Tymms (1995) IN VITRO TRANSCRIPTION AND TRANSLATION PROTOCOLS: METHODS IN MOLECULAR BIOLOGY Volume 37, Garland Publishing, NY.

The invention further provides a composition comprising at least one polypeptide of the invention, at least one vector of the invention, at least one nucleic acid of the invention, at least one cell of the invention, at least one antibody of the invention, or any combination thereof and a carrier, excipient, or diluent. Such compositions can comprise any suitable amount of any suitable number of polypeptides, fusion proteins, nucleic acids, vectors, and/or cells of the invention. Also provided are pharmaceutical compositions comprising at least one polypeptide, vector, nucleic acid, cell, antibody of the invention, or any combination thereof and a pharmaceutically acceptable carrier, excipient, or diluent.

For example, in one embodiment, the invention provides composition that comprises an excipient or carrier and a plurality of more recombinant polypeptides of the invention (e.g., two, three, four, or more recombinant polypeptide), wherein the composition induces a humoral and/or T cell immune response(s) against at least one flavivirus of at least one serotype (e.g., at least one dengue of at least one dengue virus serotype) in a subject, such as a mammal. Corresponding pharmaceutical compositions comprising a pharmaceutically acceptable excipient or carrier are also provided.

In another aspect, the invention provides compositions (including pharmaceutical compositions) that comprise an excipient or carrier (or pharmaceutically acceptable excipient or carrier) and a plurality of more dengue antigens (e.g., two, three, four, or more antigens), wherein at least one of the antigen is a recombinant polypeptide of the invention and the composition induces a humoral and/or T cell immune response(s) against at least one dengue virus of at least one serotype in a subject, such as a mammal. More preferably, the combined dengue antigen composition induces a protective immune response(s) against one or more dengue viruses of at least two, three, or all four virus serotypes in a subject.

In another aspect, the invention provides a composition (or pharmaceutical composition) comprising: (1) an excipient or carrier (or pharmaceutically acceptable excipient or carrier); (2) a polynucleotide comprising a nucleic acid sequence, that when expressed in a subject (e.g., mammal), produces a recombinant polypeptide of the invention); and (3) at least one additional nucleic acid sequence encoding an WT or recombinant dengue virus antigen and/or at least one WT or recombinant dengue virus antigen polypeptide. Such a recombinant or WT dengue virus antigen may in the form of, e.g., a WT or recombinant tE polypeptide, full E polypeptide, PRM15/tE polypeptide, C15/full prM/full E polypeptide, PRM15/full E polypeptide, or C15/full prM/tE polypeptide. Such composition induces a humoral and/or T cell response(s), and preferably a protective immune response against one or more dengue viruses of multiple virus serotypes in a subject. In such compositions, the recombinant nucleic acid of the invention, which encodes a recombinant polypeptide of the invention, and the nucleic acid sequence encoding at least one additional dengue virus antigen(s) can be in the same polynucleotide, or located on two or more different or separate polynucleotides, and, if desired, the various polynucleotide sequences can be isolated or positioned in one or more suitable vectors. In such compositions, the at least one additional dengue antigen co-administered and/or co-expressed with the recombinant polypeptide of the invention can be a recombinant polypeptide of the invention, a naturally occurring WT dengue virus antigen, or a known variant of a naturally occurring dengue virus antigen (e.g., a hybrid DEN-2/DEN-3 envelope as described in Bielefeldt-Ohmann et al., *J. Gen Virol* 78(11):2723-2733 (1997)). In one aspect, the at least one additional dengue antigen comprises at least one naturally occurring epitope (e.g., T cell epitope), such that the composition induces an immune response (e.g., T cell response) that is essentially equivalent to the immune response (e.g., T cell response) induced by a corresponding WT dengue virus antigen of the same or similar format (e.g., WT tE polypeptide, full E polypeptide, PRM15/tE polypeptide, C15/full prM/full E polypeptide, PRM15/full E polypeptide, or C15/full prM/tE polypeptide). Usually, in all of the analyses described throughout, for proper comparison, a recombinant dengue virus antigen is compared with WT dengue virus antigen having the same or a substantially similar format and/or size (e.g., a recombinant PRM15/tE polypeptide is compared with a WT PRM15/tE polypeptide). Similarly, a nucleic acid encoding a recombinant dengue virus antigen of a particular format and/or size is compared with a nucleic acid encoding a WT dengue virus antigen having the same or substantially similar format or size.

In one aspect, a composition of the invention includes a polynucleotide comprising a first nucleic acid sequence encoding a polypeptide of the invention that induces a neutralizing antibody response against at least one dengue virus of each of at least two dengue virus serotypes (and preferably against one or more dengue viruses of all four serotypes) and a plurality of additional nucleic acid sequences encoding peptides comprising known virus epitopes (e.g., T cell epitopes) from DEN-1, DEN-2, DEN-3, and/or DEN-4.

Additionally or alternatively, the composition can include one or more polypeptides of the invention selected for the retention of at least one known wild-type dengue epitope (e.g., T cell epitope). Such wild-type dengue epitopes are known in the art and include, e.g., the regions of the DEN-2 envelope protein comprising from about amino acid residues 35-50, 59-78, 135-157, 145-169, 240-250, 270-298, 295-307, 335-354, and/or 356-376 (see, e.g., Rothman et al., *J Virol* 70(10):6540-6546 (1996), Leclerc et al. *Mol Immunol* 30(7): 613-625 (1993), and Roehrig et al. *Virology* 191(1):31-38 (1994)). Additionally, epitopes (e.g., T cell epitopes) within dengue E and prM proteins can be identified by epitope analysis (e.g., T cell epitope analysis) by one of ordinary skill using programs and algorithms known in the art, examples of which are further described herein, and by subsequent sequence comparison to identify polypeptide(s) of the invention that retain such identified epitopes for addition to the composition.

Desirably, a pharmaceutical composition of the invention comprises a pharmaceutically acceptable excipient or carrier and an antigenic or immunogenic amount of at least one recombinant polypeptide, polynucleotide, or vector of the invention (or a combination of any of these) sufficient to induce a immune response to at least one flavivirus (e.g., a dengue virus) of at least one serotype in a subject to which the pharmaceutical composition is administered in vivo or via ex vivo methods. In one particular aspect, the an amount of at least recombinant polypeptide, polynucleotide, or vector of the invention in the pharmaceutical composition is sufficient to induce a protective immune response in a subject to which the pharmaceutical composition is administered; that is, the amount is sufficient to protect against infection by the at least one flavivirus of at least one serotype. In another aspect, the pharmaceutical composition comprises a pharmaceutically acceptable excipient or carrier and an antigenic or immunogenic amount of at least one recombinant polypeptide, polynucleotide, or vector of the invention (or a combination of any of these) sufficient to induce a immune response in a subject to which the composition is delivered against at least one dengue virus of at least two, at least three, or four virus serotypes.

The composition (or pharmaceutical composition) can be any non-toxic composition that does not interfere with the immunogenicity of the at least one polypeptide, polynucleotide, or vector of the invention included therein. The composition can comprise one or more excipients or carriers, and the pharmaceutical composition comprises one or more pharmaceutically acceptable carriers. A wide variety of acceptable carriers, diluents, and excipients are known in the art. There are a wide variety of suitable formulations of compositions and pharmaceutical compositions of the present invention. For example, a variety of aqueous carriers can be used, e.g., buffered saline, such as phosphate-buffered saline (PBS), and the like are advantageous in injectable formulations of the polypeptide, polynucleotide, and/or vector of the invention. These solutions are preferably sterile and generally free of undesirable matter. These compositions may be sterilized by conventional, well known sterilization techniques. The compositions may comprise pharmaceutically acceptable auxiliary substances as required to approximate physiological conditions, such as, e.g., pH adjusting and buffering agents, toxicity adjusting agents and the like, for example, sodium acetate, sodium chloride, potassium chloride, calcium chloride, sodium lactate and the like. Any suitable carrier can be used in the administration of the polynucleotide, polypeptide, and/or vector of the invention, and several carriers for administration of therapeutic proteins are known in the art.

The composition, pharmaceutical composition and/or pharmaceutically acceptable carrier also can include diluents, fillers, salts, buffers, detergents (e.g., a nonionic detergent, such as Tween-80), stabilizers, stabilizers (e.g., sugars or protein-free amino acids), preservants, tissue fixatives, solubilizers, and/or other materials suitable for inclusion in a pharmaceutically composition. Examples of suitable components of the pharmaceutical composition in this respect are described in, e.g., Berge et al., *J. Pharm. Sci.*, 66(1), 1-19 (1977), Wang and Hanson, *J. Parenteral. Sci. Tech.*, 42, S4-S6 (1988), U.S. Pat. Nos. 6,165,779 and 6,225,289, and elsewhere herein. The pharmaceutical composition also can include preservatives, antioxidants, or other additives known to those of skill in the art. Additional pharmaceutically acceptable carriers are known in the art. Examples of additional suitable carriers are described in, e.g., Urquhart et al., *Lancet*, 16, 367 (1980), Lieberman et al., PHARMACEUTICAL DOSAGE FORMS—DISPERSE SYSTEMS (2nd ed., vol. 3, 1998), Ansel et al., PHARMACEUTICAL DOSAGE FORMS & DRUG DELIVERY SYSTEMS (7th ed. 2000), Martindale, THE EXTRA PHARMACOPEIA (31 st edition), Remington's PHARMACEUTICAL SCIENCES (16th-20th editions), THE PHARMACOLOGICAL BASIS OF THERAPEUTICS, Goodman and Gilman, Eds. (9th ed.—1996), WILSON AND GISVOLDS TEXTBOOK OF ORGANIC MEDICINAL AND PHARMACEUTICAL CHEMISTRY, Delgado and Remers, Eds. (10th ed.—1998), and U.S. Pat. Nos. 5,708,025 and 5,994,106. Principles of formulating pharmaceutically acceptable compositions are described in, e.g., Platt, *Clin. Lab Med.*, 7, 289-99 (1987), Aulton, PHARMACEUTICS: THE SCIENCE OF DOSAGE FORM DESIGN, Churchill Livingstone (New York) (1988), EXTEMPORANEOUS ORAL LIQUID DOSAGE PREPARATIONS, CSHP (1998), and "Drug Dosage," *J. Kans. Med. Soc.*, 70(1), 30-32 (1969). Additional pharmaceutically acceptable carriers particularly suitable for administration of vectors are described in, for example, International Patent Application WO 98/32859.

The composition or pharmaceutical composition of the invention can comprise or be in the form of a liposome. Suitable lipids for liposomal formulation include, without limitation, monoglycerides, diglycerides, sulfatides, lysolecithin, phospholipids, saponin, bile acids, and the like. Preparation of such liposomal formulations is described in, e.g., U.S. Pat. Nos. 4,837,028 and 4,737,323.

The form of the compositions or pharmaceutical composition can be dictated, at least in part, by the route of administration of the polypeptide, polynucleotide, cell, and/or vector of interest. Because numerous routes of administration are possible, the form of the pharmaceutical composition and/or components thereof can vary. For example, in transmucosal or transdermal administration, penetrants appropriate to the barrier to be permeated are preferably included in the composition. Such penetrants are generally known in the art, and include, for example, for transmucosal administration, detergents, bile salts, and fusidic acid derivatives. In contrast, in transmucosal administration can be facilitated through the use of nasal sprays or suppositories.

A common administration form for compositions, including pharmaceutical compositions, comprising the polypeptides and/or polynucleotides of the invention is by injection. Injectable pharmaceutically acceptable compositions comprise one or more suitable liquid carriers such as water, petroleum, physiological saline, bacteriostatic water, Cremophor ELTM (BASF, Parsippany, N.J.), phosphate buffered saline (PBS), or oils. Liquid pharmaceutical compositions can further include physiological saline solution, dextrose (or other saccharide solution), polyols, or glycols, such as ethylene glycol, propylene glycol, PEG, coating agents which promote proper fluidity, such as lecithin, isotonic agents, such as mannitol or sorbitol, organic esters such as ethyoleate, and absorption-delaying agents, such as aluminum monostearate and gelatins. Preferably, the injectable composition is in the form of a pyrogen-free, stable, aqueous solution. Preferably, the injectable aqueous solution comprises an isotonic vehicle such as sodium chloride, Ringer's injection solution, dextrose, lactated Ringer's injection solution, or an equivalent delivery vehicle (e.g., sodium chloride/dextrose injection solution). Formulations suitable for injection by intraarticular (in the joints), intravenous, intramuscular, intradermal, subdermal, intraperitoneal, and subcutaneous routes, include aqueous and non-aqueous, isotonic sterile injection solutions, which can include antioxidants, buffers, bacteriostats, and solutes that render the formulation isotonic with the blood of the intended recipient (e.g., PBS and/or saline solutions, such as 0.1 M NaCl), and aqueous and non-aqueous sterile suspensions that can include suspending agents, solubilizers, thickening agents, stabilizers, and preservatives.

The administration of a polypeptide, polynucleotide, or vector of the invention can be facilitated by a delivery device be formed of any suitable material. Examples of suitable matrix materials for producing non-biodegradable administration devices include hydroxapatite, bioglass, aluminates, or other ceramics. In some applications, a sequestering agent, such as carboxymethylcellulose (CMC), methylcellulose, or hydroxypropylmethylcellulose (HPMC), can be used to bind the polypeptide, polynucleotide, or vector to the device for localized delivery.

In another aspect, a polynucleotide or vector of the invention can be formulated with one or more poloxamers, polyoxyethylene/polyoxypropylene block copolymers, or other surfactants or soap-like lipophilic substances for delivery of the polynucleotide or vector to a population of cells or tissue or skin of a subject in vivo, ex vivo, or in in vitro systems. See e.g., U.S. Pat. Nos. 6,149,922, 6,086,899, and 5,990,241, each of which is incorporated herein by reference in its entirety for all purposes.

Vectors and polynucleotides of the invention can be desirably associated with one or more transfection-enhancing agents. In some embodiments, a nucleic acid and/or nucleic acid vector of the invention typically is associated with stability-promoting salts, carriers (e.g., PEG), and/or formulations that aid in transfection (e.g., sodium phosphate salts, dextran carriers, iron oxide carriers, or biolistic delivery ("gene gun") carriers, such as gold bead or powder carriers) (see, e.g., U.S. Pat. No. 4,945,050). Additional transfection-enhancing agents include viral particles to which the nucleic acid/nucleic acid vector can be conjugated, a calcium phosphate precipitating agent, a protease, a lipase, a bipuvicaine solution, a saponin, a lipid (preferably a charged lipid), a liposome (preferably a cationic liposome, examples of which are described elsewhere herein), a transfection facilitating peptide or protein-complex (e.g., a poly(ethylenimine), polylysine, or viral protein-nucleic acid complex), a virosome, or a modified cell or cell-like structure (e.g., a fusion cell).

Nucleic acids of the invention can also be delivered by in vivo or ex vivo electroporation methods, including, e.g., those described in U.S. Pat. Nos. 6,110,161 and 6,261,281 and Widera et al., *J. of Immunol.* 164: 4635-4640 (2000), each of which is incorporated herein by reference in its entirety for all purposes.

Transdermal administration of at least one recombinant polypeptide, polynucleotide, and/or vector of the invention can be facilitated by a transdermal patch comprising the at least one polypeptide, polynucleotide, and/or vector in any suitable composition in any suitable form. Such transdermal patch devices are provided by the invention. For example, the at least one polypeptide, polynucleotide, and/or vector can be contained in a liquid reservoir in a drug reservoir patch device, or, alternatively, the polypeptide and/or polynucleotide can be dispersed throughout a material suitable for incorporation in a simple monolithic transdermal patch device. Typically, the patch comprises an immunogenic or antigenic amount of the polypeptide. Examples of such patch devices are known in the art. The patch device can be either a passive device or a device capable of iontophoretic delivery of the at least polypeptide, polynucleotide, and/or vector to the skin or tissue of the subject. Methods of promoting immunity to at least one dengue virus of at least one serotype in a subject comprise administering such a transdermal patch to the skin of the subject for a period of time and under conditions sufficient to promote immunity to the at least one dengue virus.

The composition, particularly the pharmaceutical composition, desirably comprises an amount of at least one polynucleotide, polypeptide, and/or vector in a dose sufficient to induce a protective immune response in a subject, preferably a human, upon administration. The composition can comprise any suitable dose of the at least one polypeptide, polynucleotide, and/or vector. Proper dosage can be determined by any suitable technique. In a simple dosage testing regimen, low doses of the composition are administered to a test subject or system (e.g., an animal model, cell-free system, or whole cell assay system). Considerations in dosing for immunogenic polypeptide, polynucleotide, and/or vector compositions (as well as for gene transfer by viral vectors) are known in the art. Briefly, dosage is commonly determined by the efficacy of the particular nucleic acid, polypeptide, and/or vector, the condition of the patient, as well as the body weight and/or target area of the patient to be treated. The size of the dose is also determined by the existence, nature, and extent of any adverse side-effects that accompany the administration of any such particular polypeptide, nucleic acid, vector, formulation, composition, transduced cell, cell type, or the like in a particular patient. Principles related to dosage of therapeutic and prophylactic agents are provided in, e.g., Platt, *Clin. Lab Med.*, 7, 289-99 (1987), "Drug Dosage," *J. Kans. Med. Soc.*, 70(1), 30-32 (1969), and other references described herein (e.g., Remington's, supra).

Typically, a nucleic acid composition of the invention comprises from about 1 µg to about 10 mg of at least one nucleic acid of the invention, including about 1 µg to about 15 mg, including about 1 µg to about 10 mg, about 500 µg to about 10 mg, about 500 µg to about 5 mg, about 1 mg to about 5 mg, about 2 mg to about 5 mg, about 1 µg to about 2 mg, including about 1 µg to about 1 mg, about 1 µg to about 500 µg, 1 µg to about 100 µg, 1 µg to about 50 µg, and 1 µg to about 10 µg of the nucleic acid. For delivery of a vector comprising a nucleic acid of the invention, the same amount(s) can be administered. In one aspect, the composition to be administered to a host comprises about 1, 2, 5, or 10 mg of a nucleic acid or vector of the invention. A mixture of two or more nucleic acids of the invention (or mixture of two or more vectors, each encoding a nucleic acid of the invention) can be administered in such amount(s). The volume of carrier or diluent in which such nucleic acid is administered depends upon the amount of nucleic acid to be administered. For example, 2 mg nucleic acid is typically administered in a 1 mL volume of carrier or diluent. The amount of nucleic acid in the composition depends on the host to which the nucleic acid composition is to be administered, the characteristics of the nucleic acid (e.g., gene expression level as determined by the encoded peptide, codon optimization, and/or promoter profile), and the form of administration. For example, biolistic or "gene gun" delivery methods of as little as about 1 µg of nucleic acid dispersed in or on suitable particles is effective for inducing an immune response even in large mammals such as humans. In some instances, biolistic delivery of at least about 5 µg, more preferably at least about 10 µg, or more nucleic acid may be desirable. Biolistic delivery of nucleic acids is discussed further elsewhere herein.

For injection of a nucleic acid composition, a larger dose of nucleic acid typically will be desirable. In general, an injectable nucleic acid composition comprises at least about 1 µg nucleic acid, typically about 5 µg nucleic acid, more typically at least about 25 µg of nucleic acid or at least about 30 µg of nucleic acid, 50 µg of nucleic acid, usually at least about 75 µg or at least about 80 μg of the nucleic acid, preferably at least about 100 μg or at least about 150 μg nucleic acid, preferably at least about 500 μg, at least about 1 mg, at least about 2 mg nucleic acid, at least about 5 mg nucleic acid, or more. In some instances, the injectable nucleic acid composition may comprise about 0.25-5 mg of the nucleic acid, typically in a volume of diluent, carrier, or excipient of about 0.5-1 mL. Commonly, an injectable nucleic acid solution comprises about 0.5 mg, about 1 mg, 1.5 mg, or even about 2 mg nucleic acid, usually in a volume of about 0.25 mL, about 0.5 mL, 0.75 mL, or about 1 mL. In one aspect, 2 mg nucleic acid is typically administered in a 1 mL volume of carrier, diluent, or excipient (e.g., PBS or saline). However, in some instances, lower injectable doses (e.g., less than about 5 μg, such as, e.g., about 4 μg, about 3, about 2 μg, or about 1 μg) of the polynucleotide of the invention are about equally or more effective in producing an antibody response than the above-described higher doses.

A viral vector composition of the invention can comprise any suitable number of viral vector particles. The dosage of viral vector particles or viral vector particle-encoding nucleic acid depends on the type of viral vector particle with respect to origin of vector (e.g., whether the vector is an alphaviral vector, papillomaviral vector, HSV vector, and/or an AAV vector), whether the vector is a transgene expressing or recombinant peptide displaying vector, the host, and other considerations discussed above. Generally, with respect to gene transfer vectors, the pharmaceutically acceptable composition comprises at least about $1 \times 10^2$ viral vector particles in a volume of about 1 mL (e.g., at least about $1 \times 10^2$ to about $1 \times 10^8$ particles in about 1 mL). Higher dosages also can be suitable (e.g., at least about $1 \times 10^6$, about $1 \times 10^8$, about $1 \times 10^9$, about $1 \times 10^{10}$, or more particles/mL).

Nucleic acid compositions of the invention can comprise additional nucleic acids. For example, a nucleic acid can be co-administered with a second immunostimulatory sequence or a second cytokines/adjuvant-encoding sequence (e.g., a sequence encoding an IFN-gamma and/or a GM-CSF). Examples of such sequences are described above.

The invention further provides a composition comprising a plurality of VLPs (of at least one type) formed from, e.g., recombinant C15/full prM/full E polypeptides or full prM/full E polypeptides of the invention. Desirably, the composition comprises a dose of VLPs sufficient to induce protective immunity in a subject, such as a mammalian host. Dosage considerations for VLPs are similar to those described above with respect to viral vector particles and other compositions of the invention.

The invention also provides a composition comprising an aggregate of two or more polypeptides of the invention. Moreover, the invention provides a composition comprising a population of one or more multimeric polypeptides of the invention. In particular, recombinant dengue antigens of the invention can form dimers (and in some instances trimers) in certain conditions and can retain such a multimeric state in a subject, e.g., mammalian host, as shown in the Examples below.

The invention further provides methods of making and using the polypeptides, polynucleotides, vectors, and cells of the invention. In one aspect, the invention provides a method of making a recombinant polypeptide of the invention by introducing a nucleic acid of the invention into a population of cells in a culture medium, culturing the cells in the medium (for a time and under conditions suitable for desired level of gene expression) to produce the polypeptide, and isolating the polypeptide from the cells, culture medium, or both. The polypeptide can be isolated from cell lysates, and/or cell culture medium by first concentrating the culture medium using centrifugal filters (Amicon), alternatively, by precipitating the polypeptides with ammonium sulfate or polyethylene glycol and then resuspending the polypeptides in PBS or other suitable buffers. The polypeptides can then be purified using either size-exclusion chromatography on Sephacryl S-400 column (Amersham Biosciences) as described in, e.g., Hjorth, R. and J. Moreno-Lopez. 1982., J. Virol. Methods 5:151-158, or another affinity chromatography, or by centrifugation through 20-60% sucrose gradients as described in, e.g., Konish, E., S. et al., 1992, Virology 188:714-720 (see FIGS. 15A-15B). Fractions containing the desired polypeptides can be identified by ELISA or SDS-PAGE followed by protein silver stain and immunoblotting. The desired fractions are pooled and further concentrated. Sucrose in gradient centrifugation fractions can be removed using PD-10 column (Amersham Biosciences) gel filtration. Additional purification techniques include hydrophobic interaction chromatography (Diogo, M. M, et al., 2001., J Gene Med. 3:577-584) or any other suitable technique known in the art. A variety of polypeptide purification methods are well known in the art, including those set forth in, e.g., Sandana (1997) BIOSEPARATION OF PROTEINS, Academic Press, Inc., Bollag et al. (1996) PROTEIN METHODS, $2^{nd}$ Edition Wiley-Liss, NY, Walker (1996) THE PROTEIN PROTOCOLS HANDBOOK Humana Press, NJ, Harris and Angal (1990) PROTEIN PURIFICATION APPLICATIONS: A PRACTICAL APPROACH IRL Press at Oxford, Oxford, England, Scopes (1993) PROTEIN PURIFICATION: PRINCIPLES AND PRACTICE $3^{rd}$ Edition Springer Verlag, NY, Janson and Ryden (1998) PROTEIN PURIFICATION: PRINCIPLES, HIGH RESOLUTION METHODS AND APPLICATIONS, Second Edition Wiley-VCH, NY; and Walker (1998) PROTEIN PROTOCOLS ON CD-ROM Humana Press, NJ. Cells suitable for polypeptide production are known in the art and are discussed elsewhere herein (e.g., Vero cells, 293 cells, BHK, CHO, and COS cells can be suitable). Cells can be lysed by any suitable technique including, e.g., sonication, microfluidization, physical shear, French press lysis, or detergent-based lysis. The invention provides a similar method of making a polypeptide of the invention comprising inserting a vector according to the invention to the cells, culturing the cells under appropriate conditions for expression of the nucleic acid from the vector, and isolating the polypeptide from the cells, culture medium, or both. The cells chosen are based on the desired processing of the polypeptide and based on the appropriate vector (e.g., E. coli cells can be preferred for bacterial plasmids, whereas 293 cells can be preferred for mammalian shuttle plasmids and/or adenoviruses, particularly E1-deficient adenoviruses).

In addition to recombinant production, the polypeptides may be produced by direct peptide synthesis using solid-phase techniques (see, e.g., Stewart et al. (1969) SOLID-PHASE PEPTIDE SYNTHESIS, W H Freeman Co, San Francisco and Merrifield J. (1963) *J Am Chem Soc* 85:2149-2154). Peptide synthesis may be performed using manual techniques or by automation. Automated synthesis may be achieved, for example, using Applied Biosystems 431A Peptide Synthesizer (Perkin Elmer, Foster City, Calif.) in accordance with the instructions provided by the manufacturer. For example, subsequences may be chemically synthesized separately and combined using chemical methods to produce a polypeptide of the invention or fragments thereof. Alternatively, synthesized polypeptides may be ordered from any number of companies that specialize in production of polypeptides. Most commonly, polypeptides of the invention are produced by expressing coding nucleic acids and recovering polypeptides, e.g., as described above.

In another aspect, the invention provides a method of producing a polypeptide of the invention comprising introducing a nucleic acid of the invention, a vector of the invention, or a combination thereof, into a subject, which typically and preferably is a mammal (e.g., a rat, a nonhuman primate, a bat, a marmoset, a pig, or a chicken), such that a polypeptide of the invention is expressed in the subject, and the polypeptide is isolated from the animal or from a byproduct of the subject. Isolation of the polypeptide from the subject, e.g., animal, or animal byproduct can be by any suitable technique, depending on the subject and desired recovery strategy. For example, the polypeptide can be recovered from sera of mice, monkeys, or pigs expressing the polypeptide of the invention. Transgenic animals (which preferably are mammals, such as the aforementioned mammals) comprising at least one nucleic acid of the invention also are provided. The transgenic animal can have the nucleic acid integrated into its host genome (e.g., by an AAV vector, lentiviral vector, biolistic techniques performed with integration-promoting sequences, etc.) or can have the nucleic acid in maintained epichromosomally (e.g., in a non-integrating plasmid vector or by insertion in a non-integrating viral vector). Epichromosomal vectors can be engineered for more transient gene expression than integrating vectors. RNA-based vectors offer particular advantages in this respect.

The invention additionally provides a method of producing at least one antibody that binds to at least a portion of a dengue virus. The invention further provides a method of producing at least one antibody that binds to at least one dengue virus of at least one serotype, preferably binds to one or more dengue viruses of each of two or three serotypes, and more preferably binds to one or more dengue viruses of all four virus serotypes, which comprises administering an effective amount (e.g., antigenic or immunogenic amount) of at least one recombinant polypeptide of the invention or an antigenic or immunogenic fragment thereof, or an effective amount of a vector or nucleic acid encoding such at least one polypeptide, or composition comprising an effective amount of such at least one polypeptide or nucleic acid or polynucleotide encoding said at least polypeptide, to a suitable animal host or host cell. The host cell is cultured or the animal host is maintained under conditions permissive for formation of antibody-antigen complexes. Subsequently produced antibodies are recovered from the cell culture, the animal, or a byproduct of the animal (e.g., sera from a mammal). The production of antibodies can be carried out with either at least one polypeptide of the invention, or a peptide or polypeptide fragment thereof comprising at least about 10 amino acids, preferably at least about 15 amino acids (e.g., about 20 amino acids), and more preferably at least about 25 amino acids (e.g., about 30 amino acids) or more in length. Alternatively, a nucleic acid or vector can be inserted into appropriate cells, which are cultured for a sufficient time and under periods suitable for transgene expression, such that a nucleic acid sequence of the invention is expressed therein resulting in the production of antibodies that bind to the recombinant antigen encoded by the nucleic acid sequence. Antibodies thereby obtained can have diagnostic and/or prophylactic uses. The provision of such antibodies, and compositions and pharmaceutical compositions comprising such antibodies (by use of the principles described above with respect to other compositions and pharmaceutically acceptable compositions) are features of the invention.

Antibodies produced in response to at least one polypeptide of the invention, fragment thereof, or the expression of such at least one polypeptide by a vector and/or polynucleotide of the invention can be any suitable type of antibody or antibodies. Antibodies provided by the invention include, e.g., polyclonal antibodies, monoclonal antibodies, chimeric antibodies, humanized antibodies, single chain antibodies, Fab fragments, and fragments produced by a Fab expression library. Methods of producing polyclonal and monoclonal antibodies are known to those of skill in the art, and many antibodies are available. See, e.g., CURRENT PROTOCOLS IN IMMUNOLOGY, John Colligan et al., eds., Vols. I-IV (John Wiley & Sons, Inc., NY, 1991 and 2001 Supplement), and Harlow and Lane (1989) ANTIBODIES: A LABORATORY MANUAL Cold Spring Harbor Press, NY, Stites et al. (eds.) BASIC AND CLINICAL IMMUNOLOGY (4th ed.) Lange Medical Publications, Los Altos, Calif., and references cited therein, Goding (1986) MONOCLONAL ANTIBODIES: PRINCIPLES AND PRACTICE (2d ed.) Academic Press, New York, N.Y., and Kohler and Milstein (1975) *Nature* 256:495-497. Other suitable techniques for antibody preparation include selection of libraries of recombinant antibodies in phage or similar vectors. See, Huse et al. (1989) *Science* 246:1275-1281; and Ward et al. (1989) *Nature* 341: 544-546. Specific monoclonal and polyclonal antibodies and antisera will usually bind with a $K_D$ of at least about 0.1 µM, preferably at least about 0.01 µM or better, and preferably, 0.001 µM or better.

Detailed methods for preparation of chimeric (humanized) antibodies can be found in U.S. Pat. No. 5,482,856. Additional details on humanization and other antibody production and engineering techniques can be found in Borrebaeck (ed.) (1995) ANTIBODY ENGINEERING, $2^{nd}$ Ed. Freeman and Co., NY (Borrebaeck); McCafferty et al. (1996) ANTIBODY ENGINEERING, A PRACTICAL APPROACH IRL at Oxford Press, Oxford, England (McCafferty), and Paul (1995) ANTIBODY ENGINEERING PROTOCOLS Humana Press, Towata, N.J. (Paul).

Humanized antibodies are especially desirable in applications where the antibodies are used as therapeutics and/or prophylactics in vivo in mammals (e.g., such as humans) and ex vivo in cells or tissues that are delivered to or transplanted into mammals (e.g., humans). Human antibodies consist of characteristically human immunoglobulin sequences. The human antibodies of this invention can be produced in using a wide variety of methods (see, e.g., Larrick et al., U.S. Pat. No. 5,001,065, and Borrebaeck McCafferty and Paul, supra, for a review). In one embodiment, the human antibodies of the present invention are produced initially in trioma cells. Genes encoding the antibodies are then cloned and expressed in other cells, such as nonhuman mammalian cells. The general approach for producing human antibodies by trioma technology is described by Ostberg et al. (1983), *Hybridoma* 2:361-367, Ostberg, U.S. Pat. No. 4,634,664, and Engelman et al., U.S. Pat. No. 4,634,666. The antibody-producing cell lines obtained by this method are called triomas because they are descended from three cells—two human and one mouse. Triomas have been found to produce antibody more stably than ordinary hybridomas made from human cells.

Additional useful techniques for preparing antibodies are described in, e.g., Gavilodono et al., *Biotechniques* 29(1): 128-32, 134-6, and 138 (passim) (2000), Nelson et al., *Mol. Pathol.* 53(3):111-7 (2000), Laurino et al. *Ann. Clin. Lab. Sci.* 29(3):158-66 (1999), Rapley, *Mol. Biotechnol.* 3(2):139-54 (1995), Zaccolo et al., *Int. J. Clin. Lab. Res.* 23(4):192-8 (1993), Morrison, *Annu. Rev. Immunol.* 10:239-65 (1992), "Antibodies, Annigene, and Molecular Mimiery," *Meth. Enzymd.* 178 (J. J. Langone, Ed. 1989), Moore, *Clin. Chem.*, 35(9):1849-53 (1989), Rosalki et al., *Clin. Chim. Acta* 183 (1):45-58 (1989), and Tami et al., *Am. J. Hosp. Pharm.* 43(11):2816-25 (1986), as well as U.S. Pat. Nos. 4,022,878, 4,350,683, and 4,022,878. A technique for producing antibodies with remarkably high binding affinities is provided in Border et al., *Proc. Natl. Acad. Sci., USA* 97(20):10701-05 (2000).

The invention further provides a method of promoting, inducing, enhancing or modulating, a mammal's immune response to at least one dengue virus of at least one serotype comprising administering an immunogenic amount of at least one polypeptide to a mammal, such as human and non-human primates, such that an immune response to the at least one dengue virus of the at least one serotype in the mammal is promoted, induced, enhanced, or modulated. Preferably, the polypeptide is administered in a pharmaceutical composition comprising the polypeptide of the invention and a pharmaceutically acceptable carrier or excipient as described above. Typically, an injectable, pharmaceutical composition comprising a suitable, pharmaceutically acceptable carrier (e.g., PBS) and an immunogenic amount of the polypeptide is delivered intramuscularly, intraperitoneally, subdermally, transdermally, subcutaneously, or intradermally to the host for in vivo. Alternatively, biolistic protein delivery techniques (vaccine gun delivery) can be used (examples of which are discussed elsewhere herein). Any other suitable technique also can be used. Polypeptide administration can be facilitated via liposomes (examples further discussed below).

The invention also provides a method promoting an immune response to a dengue virus in a subject by administering an antigenic or immunogenic amount of at least one nucleic acid of the invention and/or at least one nucleic acid vector (NAV) of the invention, preferably in a pharmaceutical composition comprising a pharmaceutically acceptable carrier and an antigenic immunogenic amount of the at least one nucleic acid and/or at least one nucleic acid vector, to the subject.

While the following discussion is primary directed to nucleic acids, it will be understood that it applies equally (and, indeed, preferably) to nucleic acid vectors of the invention. The nucleic acid composition can be administered or delivered to the host by any suitable administration route. In some aspects of the invention, administration of the nucleic acid is parenteral (e.g., subcutaneous, intramuscular, or intradermal), topical, or transdermal. The nucleic acid can be introduced directly into a tissue, such as muscle, by injection using a needle or other similar device. See, e.g., Nabel et al. (1990), supra); Wolff et al. (1990) *Science*, 247:1465-1468), Robbins (1996) GENE THERAPY PROTOCOLS, Humana Press, NJ, and Joyner (1993) GENE TARGETING: A PRACTICAL APPROACH, IRL Press, Oxford, England, and U.S. Pat. Nos. 5,580,859 and 5,589,466. Other methods such as "biolistic" or particle-mediated transformation (see, e.g., U.S. Pat. No. 4,945,050, U.S. Pat. No. 5,036,006, Sanford et al., *J. Particulate Sci. Tech.*, 5, 27-37 (1987), Yang et al., *Proc. Natl. Acad. Sci. USA*, 87, 9568-72 (1990), and Williams et al., *Proc. Natl. Acad. Sci. USA*, 88, 2726-30 (1991)). These methods are useful not only for in vivo introduction of DNA into a subject, such as a mammal, but also for ex vivo modification of cells for reintroduction into a subject (which is discussed further elsewhere herein).

For standard gene gun administration, the vector or nucleic acid of interest is precipitated onto the surface of microscopic metal beads. The microprojectiles are accelerated with a shock wave or expanding helium gas, and penetrate tissues to a depth of several cell layers. For example, the AccelTM Gene Delivery Device manufactured by Agacetus, Inc. Middleton Wis. is suitable for use in this embodiment. The nucleic acid or vector can be delivered by such techniques, for example, intramuscularly, intradermally, subdermally, subcutaneously, and/or intraperitoneally. Additional devices and techniques related to biolistic delivery Int'l Patent Applications WO 99/2796, WO 99/08689, WO 99/04009, and WO 98/10750, and U.S. Pat. Nos. 5,525,510, 5,630,796, 5,865,796, and 6,010,478, The nucleic acid can be delivered in association with a transfection-facilitating agent, examples of which were discussed above. The nucleic acid can be delivered topically and/or by liquid particle delivery (in contrast to solid particle biolistic delivery). Examples of such nucleic acid delivery techniques, compositions, and additional constructs that can be suitable as delivery vehicles for the nucleic acids of the invention are provided in, e.g., U.S. Pat. Nos. 5,591,601, 5,593,972, 5,679,647, 5,697,901, 5,698,436, 5,739,118, 5,770,580, 5,792,751, 5,804,566, 5,811,406, 5,817,637, 5,830,876, 5,830,877, 5,846,949, 5,849,719, 5,880,103, 5,922,687, 5,981,505, 6,087,341, 6,107,095, 6,110,898, and International Patent Applications WO 98/06863, WO 98/55495, and WO 99/57275, each of which is incorporated herein by reference in its entirety for all purposes.

The choice of delivery technique and form of the antigen can influence the type of immune response observed upon administration. For example, gene gun delivery of many antigens is associated with a Th2-biased response (indicated by higher IgG1 antibody titers and comparatively low IgG2a titers). Advantageously, at least some of the VLPs of the invention are expected to overcome this Th2-bias that can be observed with the administration of other dengue virus antigens. The bias of a particular immune response enables the physician or artisan to direct the immune response promoted by administration of the polypeptide and/or polynucleotide of the invention.

Alternatively, the nucleic acid can be delivered to the host by way of liposome-based gene delivery. Exemplary techniques and principles related to liposome-based gene delivery is provided in, e.g., Debs and Zhu (1993) WO 93/24640; Mannino and Gould-Fogerite (1988) *BioTechniques* 6(7):682-691; Rose U.S. Pat. No. 5,279,833; Brigham (1991) WO 91/06309; Brigham et al. (1989) *Am J Med Sci* 298:278-281; Nabel et al. (1990) *Science* 249:1285-1288; Hazinski et al. (1991) *Am J Resp Cell Molec Biol* 4:206-209; and Wang and Huang (1987) *Proc Natl Acad Sci USA* 84:7851-7855), and Felgner et al. (1987) *Proc. Natl Acad. Sci. USA* 84:7413-7414), each of which is incorporated herein by reference in its entirety for all purposes. Suitable liposome pharmaceutically acceptable compositions that can be used to deliver the nucleic acid are further described elsewhere herein.

Any immunogenic amount of nucleic acid can be used. Typically, where the nucleic acid is administered by injection, about 50 micrograms (ug) to 5 mg, usually about 100 ug to about 2.5 mg, typically about 500 µg to about 2 mg or about 800 µg to about 1.5 mg, and often about 2 mg or about 1 mg is administered.

The amount of DNA plasmid for use in these methods where administration is via a gene gun, e.g., typically is from about 100 to about 1000 times less than the amount used for direct injection. For example, for gene gun delivery, the amount of DNA plasmid corresponding to the first range above would be from about $50 \times 10^{-8}$ g to $5 \times 10^{-5}$ g (100 times less) or from about $50 \times 10^{-9}$ to about $5 \times 10^{-6}$ g. Despite such sensitivity, preferably at least about 1 µg of the nucleic acid is used in such biolistic delivery techniques.

The expression of the nucleic acid sequence encoding the recombinant dengue antigen can be operably linked to any suitable promoter and/or other expression controls sequences, examples of which were described above. For example, expression of the polynucleotide construct can be induced by using an inducible on- and off-gene expression system. Examples of such on- and off-gene expression systems include the Tet-On™ Gene Expression System and Tet-Off™ Gene Expression System (see, e.g., Clontech Catalog 2000, pg. 110-111 for a detailed description of each such system), respectively.

Delivery of a viral vector of the invention also can promote an immune response to at least one dengue virus of at least one serotype in a subject. Any suitable viral vector, in any suitable concentration, can be used to induce the immune response. For example, to the subject host can be administered a population of retroviral vectors (examples of which are described in, e.g., Buchscher et al. (1992) *J. Virol*. 66(5) 2731-2739, Johann et al. (1992) *J. Virol*. 66 (5):1635-1640 (1992), Sommerfelt et al., (1990) *Virol*. 176:58-59, Wilson et al. (1989) *J. Virol*. 63:2374-2378, Miller et al., *J. Virol*. 65:2220-2224 (1991), Wong-Staal et al, PCT/US94/05700, Rosenburg and Fauci (1993) in FUNDAMENTAL IMMUNOLOGY, THIRD EDITION Paul (ed) Raven Press, Ltd., New York and the references therein), an AAV vector (as described in, e.g., West et al. (1987) *Virology* 160:38-47, Kotin (1994) *Human Gene Therapy* 5:793-801, Muzyczka (1994) *J. Clin. Invst*. 94:1351, Tratschin et al. (1985) *Mol. Cell. Biol*. 5(11):3251-3260, U.S. Pat. Nos. 4,797,368 and 5,173,414, and International Patent Application WO 93/24641), or an adenoviral vector (as described in, e.g., Berns et al. (1995) *Ann. NY Acad. Sci.* 772:95-104; Ali et al. (1994) *Gene Ther*. 1:367-384; and Haddada et al. (1995) *Curr. Top. Microbiol. Immunol*. 199 (Pt 3):297-306), such that immunogenic levels of expression of the nucleic acid included in the vector thereby occurs in vivo resulting in the desired immune response. Other suitable types of viral vectors are described elsewhere herein (including alternative examples of suitable retroviral, AAV, and adenoviral vectors).

Suitable infection conditions for these and other types of viral vector particles are described in, e.g., Bachrach et al., *J. Virol*., 74(18), 8480-6 (2000), Mackay et al., *J. Virol*., 19(2), 620-36 (1976), and FIELDS VIROLOGY, supra. Additional techniques useful in the production and application of viral vectors are provided in, e.g., "Practical Molecular Virology: Viral Vectors for Gene Expression" in METHODS IN MOLECULAR BIOLOGY, vol. 8, Collins, M. Ed., (Humana Press 1991), VIRAL VECTORS: BASIC SCIENCE AND GENE THERAPY, 1st Ed. (Cid-Arregui et al., Eds.) (Eaton Publishing 2000), "Viral Expression Vectors," in CURRENT TOPICS IN MICROBIOLOGY AND IMMUNOLOGY, Oldstone et al., Eds. (Springer-Verlag, N.Y. 1992), and "Viral Vectors" in CURRENT COMMUNICATIONS IN BIOTECHNOLOGY, Gluzman and Hughes, Eds. (Cold Spring Harbor Laboratory Press, 1988).

The toxicity and therapeutic efficacy of the vectors that include recombinant molecules provided by the invention can be determined using standard pharmaceutical procedures in cell cultures or experimental animals. For example, the artisan can determine the $LD_{50}$ (the dose lethal to 50% of the population) and the $ED_{50}$ (the dose therapeutically effective in 50% of the population) using procedures presented herein and those otherwise known to those of skill in the art. Nucleic acids, polypeptides, proteins, fusion proteins, transduced cells and other formulations of the present invention can be administered at a rate determined, e.g., by the $LD_{50}$ of the formulation, and the side-effects thereof at various concentrations, as applied to the mass and overall health of the patient. Administration can be accomplished via single or divided doses.

The viral vector can be targeted to particular tissues, cells, and/or organs. Examples of such vectors are described above. E.g., the viral vector or nucleic acid vector can be used to selectively deliver the nucleic acid sequence of the invention to monocytes, dendritic cells, cells associated with dendritic cells (e.g., keratinocytes associated with Langerhans cells), T-cells, and/or B-cells. The viral vector can be a replication-deficient viral vector. The viral vector particle also can be modified to reduce host immune response to the viral vector, thereby achieving persistent gene expression. Such "stealth" vectors are described in, e.g., Martin, *Exp. Mol. Pathol.*, 66(1):3-7 (1999), Croyle et al., *J. Virol.*, 75(10): 4792-801 (2001), Rollins et al., *Hum. Gene Ther.*, 7(5), 619-26 (1996), Ikeda et al., *J. Virol.*, 74(10):4765-75 (2000), Halbert et al., *J. Virol.*, 74(3), 1524-32 (2000), and Int'l Patent Appn WO 98/40509. Alternatively or additionally, the viral vector particles can be administered by a strategy selected to reduce host immune response to the vector particles. Strategies for reducing immune response to the viral vector particle upon administration to a host are provided in, e.g., Maione et al., *Proc. Natl. Acad. Sci. USA*, 98(11), 5986-91 (2001), Morral et al., *Proc. Natl. Acad. Sci. USA*, 96(22), 2816-21 (1999), Pastore et al., *Hum. Gene Ther.*, 10(11), 1773-81 (1999), Morsy et al., *Proc. Natl. Acad. Sci. USA*, 95(14), 7866-71 (1998), Joos et al., *Hum. Gene Ther.*, 7(13), 1555-66 (1996), Kass-Eisler et al., *Gene Ther.*, 3(2), 154-62 (1996), U.S. Pat. Nos. 6,093,699, 6,211,160, 6,225,113, U.S. Pat. Appn 2001-0066947A1.

Any suitable population and concentration (dosage) of viral vector particles can be used to induce the immune response in the subject host. In some aspects of the invention, at least about $1\times10^2$ particles are typically used (e.g., the method can comprises administering a composition comprising at least from about $1\times10^2$ particles/mL to about $1\times10^9$ particles/mL of a suitable viral vector particle in about 1-2 mL injectable and pharmaceutically acceptable solution). When delivered to a host, the population of viral vector particles is such that the multiplicity of infection (MOI) desirably is at least from about 1 to about 100 and more preferably from at least about 5 to about 30. Considerations in viral vector particle dosing are described elsewhere herein.

The term "prime" generally refers to the administration or delivery of a polypeptide of the invention (e.g., recombinant dengue virus antigen) or a polynucleotide encoding such polypeptide to a cell culture or population of cells in vitro, or in vivo to a subject or ex vivo to tissue or cells of a subject. The first administration or delivery (primary contact) may not be sufficient to induce or promote a measurable response (e.g., antibody response), but may be sufficient to induce a memory response, or an enhanced secondary response. The term "challenge" generally refers to any procedure that induces, promotes, or modulates an immune response.

Preferably, the initial delivery or administration of a polypeptide or polynucleotide of the invention to cells or a cell culture in vitro, or in vivo or ex vivo to tissue or cells of a subject is followed by one or more secondary (usually repeat) administrations of the polynucleotide and/or polypeptide. For example, initial administration of a polypeptide composition can be followed, typically at least about 7 days after the initial polypeptide administration (more typically about 14-35 days or about 2, 4, 6, 12, or 24 months) after initial polypeptide administration), with a first repeat administration ("prime boost") of a substantially similar (if not identical) dose of the polypeptide, typically in a similar amount as the first administration (e.g., about 5 μg to about 1 mg, or about 5 μg to 0.1 mg of polypeptide in a 1-2 mL injectable and pharmaceutically acceptable solution). Desirably, a second repeat administration (or "secondary boost") is performed with a similar, if not identical, dose of the polypeptide composition at about 2-9, 3-6 months, 9-18 months, or about 12 or 24 months after the initial polypeptide administration.

Any technique comprising administering a polypeptide of the invention can also include the co-administration of one or more suitable adjuvants. Examples of suitable adjuvants include Freund's emulsified oil adjuvants (complete and incomplete), alum (aluminum hydroxide and/or aluminum phosphate), lipopolysaccharides (e.g., bacterial LPS), liposomes (including dried liposomes and cytokine-containing (e.g., IFN-γ-containing and/or GM-CSF-containing) liposomes), endotoxins, calcium phosphate and calcium compound microparticles (see, e.g., International Patent Application WO 00/46147), mycobacterial adjuvants, Arlacel A, mineral oil, emulsified peanut oil adjuvant (adjuvant 65), *Bordetella pertussis* products/toxins, Cholera toxins, nonionic block polymer surfactants, Corynebacterium granulosum derived P40 component, fatty acids, aliphatic amines, paraffinic and vegetable oils, beryllium, and immunostimulating complexes (ISCOMs—reviewed in, e.g., Höglund et al. "ISCOMs and immunostimulation with viral antigens" in SUBCELLULAR BIOCHEMISTRY (Ed. Harris, J. R.) Plenum, N.Y., 1989, pp. 39-68), Morein et al., "The ISCOM—an approach to subunit vaccines" in RECOMBINANT DNA VACCINES: RATIONALE AND STRATEGY (Ed. Isaacson, R. E.) Marcel Dekker, N.Y., 1992, pp. 369-386, and Morein et al., *Clin Immunotherapeutics* 3:461-75 (1995)). Recently, monophosphoryl lipid A, ISCOMs with Quil-A, and Syntex adjuvant formulations (SAFs) containing the threonyl derivative or muramyl dipeptide also have been under consideration for use in human vaccines. Numerous types of adjuvants that can be suitable for co-administration or serial administration with one or more polypeptides of the invention are known in the art. Examples of such adjuvants are described in, e.g., Vogel et al., A COMPENDIUM OF VACCINE ADJUVANTS AND EXCIPIENTS (2d Ed) (http://www.niaid.nih.gov/aidsvaccine/pdf/compendium.pdf—accessed Jan. 24, 2002), Bennet et al., *J. Immun Meth* 153:31-40 (1992), Bessler et al., *Res Immunol*, 143(5): 519-25 (1992), Woodard, *Lab Animal Sci* 39(3):222-5 (1989), Vogel, *AIDS Res and Human Retroviruses* 11(10):1277-1278 (1995), Leenaars et al., *Vet Immunol Immunopath* 40:225-241 (1995), Linblak et al., *Scandinavian J Lab Animal Sci* 14:1-13 (1987), Buiting et al. *Res Immunol* 143(5):541-548 (1992), Gupta and Siber, *Vaccine* (14):1263-1276 (1996), and U.S. Pat. Nos. 6,340,464, 6,328,965, 6,299,884, 6,083,505, 6,080,725, 6,060,068, 5,961,970, 5,814,321, 5,747,024, 5,690,942, 5,679,356, 5,650,155, 5,585,099, 4,395,394, and 4,370,265.

Administration of a nucleic acid of the invention also is typically and preferably followed by boosting (at least a prime, preferably at least a prime and secondary boost). A "prime" is typically the first immunization. An initial nucleic acid administration can be followed by a repeat administration of the nucleic acid at least about 7 days, more typically and preferably about 14-35 days, or about 2, 4, 6, 9, or 12 months, after the initial nucleic acid administration. The amount administered in the repeat administration is typically substantially similar (if not identical) to the dose of the nucleic acid initially administered, (e.g., about 50 μg to about 15 or 20 mg, or 1 mg to about 10 mg, or 2-5 mg in a 1-2 mL volume injectable and pharmaceutically acceptable solution).

Alternatively, the initial administration of the nucleic acid can be followed by a prime boost of an immunogenic amount of polypeptide at such a time. Preferably, in such aspects, a secondary boost also is preferably performed with nucleic acid and/or polypeptide, in an amount similar to that used in the primary boost and/or the initial nucleic acid administration, at about 2-9, 3-6 months, 9-18 months, or about 12 or 24 months after the initial polypeptide administration. Any number of boosting administrations of nucleic acid and/or polypeptide can be performed.

The polypeptide, nucleic acid, and/or vector of the invention can be used to promote any suitable immune response to at least one dengue virus of one or more serotypes in any suitable context. For example, at least one recombinant polypeptide, nucleic acid, and/or vector can be administered as a prophylactic in an immunogenic or antigenic amount to a mammal (preferably, a human) that has not been infected with a dengue virus of a particular serotype. Favorably, the administration of the at least one recombinant polypeptide, nucleic acid, and/or vector induces a protective immune response against challenge with at least one dengue virus of at least one serotype, and, as such, can be considered a "vaccine" against dengue virus infection by said at least one dengue virus of the at least one serotype. Preferably, the administration of the at least one recombinant polypeptide, nucleic acid, and/or vector induces a protective immune response against challenge with at least one dengue virus of each at least two serotypes, at least three serotypes, and preferably at least four serotypes and, as such, can be considered a "vaccine" against dengue virus infection by viruses of the at least two, at least three or all four dengue virus serotypes, respectively.

In an advantage aspect, at least one polypeptide, polynucleotide, and/or vector of the invention is administered to a mammal, preferably a human, that has been previously infected with at one dengue virus of at least one particular serotype, such that a protective immune response (such as, e.g., a neutralizing antibody immune response) to one or more dengue viruses of other serotypes is induced in the mammal (human), most preferably without the occurrence of ADE upon administration of the at least one polynucleotide, polypeptide, and/or vector, as well as upon challenge with one or more dengue viruses of serotypes other than the serotype of the dengue virus with the mammal was previously infected. The at least one polypeptide, polynucleotide, and/or vector also can be administered to a mammal (e.g., a human) actively infected with at least one dengue virus of one serotype, to aid in the production of an immune response against further dengue virus infections. Most preferably, the polypeptide, nucleic acid, and/or vector is administered in an amount sufficient to induce a protective immune response in a human at risk for dengue virus infection (or at specific risk for DF and/or DHF), or that is or has been previously infected with a dengue virus of at least one serotype, to avoid DHF upon secondary infection, preferably without the occurrence of ADE.

The polynucleotides and vectors of the invention can be delivered by ex vivo delivery of cells, tissues, or organs. As such, the invention provides a method of promoting an immune response to a dengue virus comprising inserting at least one nucleic acid of the invention and/or a vector of the invention into a population of cells and implanting the cells in a mammal. Ex vivo administration strategies are known in the art (see, e.g., U.S. Pat. No. 5,399,346 and Crystal et al., *Cancer Chemother. Pharmacol.*, 43(Suppl.), S90-S99 (1999)). Cells or tissues can be injected by a needle or gene gun or implanted into a mammal ex vivo. Briefly, in ex vivo techniques, a culture of cell (e.g., organ cells, cells of the skin, muscle, etc.) or target tissue is provided, or preferably removed from the host, contacted with the vector or polynucleotide composition, and then reimplanted into the host (e.g., using techniques described in or similar to those provided in). Ex vivo administration of the nucleic acid can be used to avoid undesired integration of the nucleic acid and to provide targeted delivery of the nucleic acid or vector. Such techniques can be performed with cultured tissues or synthetically generated tissue. Alternatively, cells can be provided or removed from the host, contacted (e.g., incubated with) an immunogenic amount of a polypeptide of the invention that is effective in prophylactically inducing an immune response to a dengue virus (preferably a protective immune response, such as a protective neutralizing antibody response) when the cells are implanted or reimplanted to the host. The contacted cells are then delivered or returned to the subject to the site from which they were obtained or to another site (e.g., including those defined above) of interest in the subject to be treated. If desired, the contacted cells may be grafted onto a tissue, organ, or system site (including all described above) of interest in the subject using standard and well-known grafting techniques or, e.g., delivered to the blood or lymph system using standard delivery or transfusion techniques. Such techniques can be performed with any suitable type of cells. For example, in one aspect, activated T cells can be provided by obtaining T cells from a subject (e.g., mammal, such as a human) and administering to the T cells a sufficient amount of one or more polypeptides of the invention to activate effectively the T cells (or administering a sufficient amount of one or more nucleic acids of the invention with a promoter such that uptake of the nucleic acid into one or more such T cells occurs and sufficient expression of the nucleic acid results to produce an amount of a polypeptide effective to activate said T cells). The activated T cells are then returned to the subject. T cells can be obtained or isolated from the subject by a variety of methods known in the art, including, e.g., by deriving T cells from peripheral blood of the subject or obtaining T cells directly from a tumor of the subject. Other preferred cells for ex vivo methods include explanted lymphocytes, particularly B cells, antigen presenting cells (APCs), such as dendritic cells, and more particularly Langerhans cells, monocytes, macrophages, bone marrow aspirates, or universal donor stem cells. A preferred aspect of ex vivo administration of a polynucleotide or polynucleotide vector can be the assurance that the polynucleotide has not integrated into the genome of the cells before delivery or readministration of the cells to a host. If desired, cells can be selected for those where uptake of the polynucleotide or vector, without integration, has occurred, using standard techniques known in the art.

The invention includes a method of inducing an immune response in a subject to at least one dengue virus of at least one serotype comprising: (a) providing a population of B cells, dendritic cells, or both; (b) transforming the cells with at least one nucleic acid of the invention such that the nucleic acid does not integrate into a genome of any of the cells, and (c) delivering an effective amount of the cells to-the subject, wherein the cells express the at least one nucleic acid after delivery and induce an immune response to the at least one dengue virus in the subject. In some such methods, prior to transforming the cells with the nucleic acid, the cells are obtained from a subject, and after transformation with the at least one nucleic acid, the cells are delivered to the same subject. Some such methods further comprise delivering at least one of the following to a subject: 1) polypeptide comprising GM-CSF or an interferon (IFN), 2) a nucleic acid encoding GM-CSF or an interferon, and 3) a nucleic acid encoding GM-CSF and an interferon.

In another aspect, the invention provides a method of inducing an immune response by administering a population of recombinant VLPs or attenuated viruses of the invention, formed by populations of polypeptides comprising, e.g., recombinant C15/full prM/full E polypeptides or full prM/full E polypeptides of the invention. The administration of VLPs or attenuated viruses is carried out using techniques similar to those used for the administration of polypeptides and viral vectors, as described above (e.g., VLPs are preferably administered in a pharmaceutically acceptable injectable solution into or through the skin, intramuscularly, or intraperitoneally). The skin and muscle are generally preferred targets for administration of the polypeptides, vectors, and polynucleotides of the invention, by any suitable technique. Thus, the delivery of the polypeptide, polynucleotide, or vector of the invention into or through the skin of a subject, e.g., mammal (preferably a human), is a feature of the invention. Such administration can be accomplished by transdermal devices, or, more typically, biolistic delivery of the polypeptide, polynucleotide, and/or vector to, into, or through the skin of the mammal, or into exposed muscle of the subject. Transdermal devices provided by the invention, described elsewhere herein, for example, can be applied to the skin of a host for a suitable period such that sufficient transfer of a polynucleotide and/or vector to the mammal occurs, thereby promoting an immune response to at least one dengue virus. Muscular administration is more typically facilitated by injection of a liquid solution comprising a polypeptide, polynucleotide, or vector of the invention. Particular cells that can be advantageously targeted include dendritic cells, other APCs, B cells, monocytes, T cells (including T helper cells), and cells associated with such immune system cells (e.g., keratinocytes or other skin cells associated with Langerhans cells). Targeting of vectors and nucleic acids of the invention is described elsewhere herein. Such targeted administration can be performed with nucleic acids or vectors comprising nucleic acids operably linked to cell and/or tissue-specific promoters, examples of which are known in the art.

The polynucleotide of the invention can be administered by any suitable delivery system, such that expression of a recombinant of the polypeptide occurs in the host resulting in an immune response to a dengue virus. For example, an effective amount of a population of bacterial cells comprising a nucleic acid of the invention can be administered to a subject, resulting in expression of a recombinant polypeptide of the invention, and induction of an immune response to dengue viruses in the subject, e.g., mammal. Bacterial cells developed for mammalian gene delivery are known in the art. In another aspect, administration of a polynucleotide or vector (preferably a polynucleotide vector) of the invention is facilitated by application of electroporation to an effective number of cells or an effective tissue target, such that the nucleic acid and/or vector is taken up by the cells, and expressed therein, resulting in production of a recombinant polypeptide of the invention therein and subsequent induction of an immune response to dengue viruses in the mammal.

In some aspects, the nucleic acid, polypeptide, and/or vector of the invention is desirably co-administered with an additional nucleic acid or additional nucleic vector comprising an additional nucleic acid that increases the immune response to a dengue virus upon administration of the nucleic acid, polypeptide, and/or vector of the invention. Preferably, such a second nucleic acid comprises a sequence encoding a GM-CSF, an interferon (e.g., IFN-gamma), or both, examples of which are discussed elsewhere herein. Alternatively, the second nucleic acid can comprise immunostimulatory (CpG) sequences, as described elsewhere herein. GM-CSF, IFN-gamma, or other polypeptide adjuvants also can be co-administered with the polypeptide, polynucleotide, and/or vector. Co-administration in this respect encompasses administration before, simultaneously with, or after, the administration of the polynucleotide, polypeptide, and/or vector of the invention, at any suitable time resulting in an enhancement of an immune response to a dengue virus.

Dengue viruses are transmitted through Aedes mosquito bites, posing a significant threat to people living in or visiting tropical areas. Dengue virus infections are clinically manifested for most of the cases by dengue fever (DF), which is a self-limited fibril illness. The severe to fatal dengue hemorrhagic fever/dengue shock syndrome (DHF/DSS), which is associated with a mortality rate between 1-5%, is often linked to secondary infections.

Multiple dengue serotypes can be prevalent in one local area, and it is therefore important to test a patient's serum samples simultaneously against such multiple serotypes, preferably those prevalent in the area in which the patient lives. In areas where all four dengue serotypes may be prevalent, it is important to test a patient's serum samples simultaneously against all 4 serotypes. For treatment, it is not always necessary to determine the specific serotype that has infected a patient; however, it is important to distinguish the specific infecting virus(es) from other viruses causing hemorrhagic fever. Cultivating or growing DEN viruses in cultures is very tedious and the quality of the virus samples obtained often varies extensively, due to the growth abilities and stability of the different viruses. This makes it difficult to produce ELISA plates with consistent antigen quality for multiple (e.g., 2, 3, especially 4) serotypes in each well. Additionally, due to the difficulty of obtaining inactivated viruses, such assay plates are very expensive and for large scale clinical testing in poor countries not affordable.

The invention provides new diagnostic assays using at least one recombinant chimeric dengue virus antigen polypeptide that displays one or more conformational epitopes of one or more of the four dengue virus serotypes and/or recognizes one or more antibodies against at least one dengue virus of each of at least one, two, three or four serotypes. Such recombinant polypeptides are recognized by type-specific antisera. Such recombinant dengue virus antigens of the invention are useful as diagnostic tools to capture antibodies against one, two, three, and preferably all 4 dengue serotypes. In a particular aspect, the invention provides diagnostic assays using at least one recombinant or synthetic polypeptide of the invention that displays one or more conformational epitopes of each of two, three, or four dengue virus serotypes (DEN-1, DEN-2, DEN-3, and/or DEN-4) and/or recognizes one or more antibodies against at least one dengue virus of each of at least, two, three or four serotypes (e.g., multivalent antigens).

In a preferred aspect, the invention provides diagnostic assays using at least one recombinant or synthetic polypeptide of the invention that displays one or more conformational epitopes of each of the four 4 DEN virus serotypes and/or recognizes antibodies against at least one dengue virus of each of the four serotypes. As shown below in detail in the Examples below, such tetravalent antigenic polypeptides induced an antibody response in vivo in subjects and are useful as vaccine candidates.

For example, four recombinant PRM15/tE polypeptides (2/7E, 5/21, 2G11, and 6E12) were selected to test as diagnostic antigens (see Example 19 below for details). Alternatively, "full-length" clones (2/7E-D1, 5/217E-D1, 2G11E-D4, and 6E12-D4) can be used. It was previously shown for TBE, another flavivirus, that expression of the viral prM and 100% of the E gene can lead to viral-like particle (VLP) formation, physically and antigenically resembling the virus particles. It is believed recombinant C15/full prM/full E (e.g., 2/7E-D1, 5/21-D1, 2G11-D4, and 6E12-D4) or full prM/full E clones of the invention form VLPs. Expressed in human 293 cells, VLP-like antigens are secreted into the medium, which allows for easy antigen isolation.

The Western blot of FIG. 13A illustrates recognition of the four tetravalent clones (2/7E, 5/21, 2G11, and 6E12) by type-specific antisera and the expression and secretion of the antigens from human 293 cells. For diagnostics, the antigens can be used for a dot blot assay, ELISA, or dipstick EIA. A dot blot assay is an advantageous assay in terms of manufacturing, storage and handling. The use of the recombinant multivalent antigens as a diagnostic tool was demonstrated by a dot blot assay as shown in Example 19. Each of these recombinant tetravalent polypeptides was well-secreted and recognized by all 4 type-specific anti-DEN antisera and thus can be used to detect serum antibodies against any of the 4 DEN serotypes in a biological human sample obtained from an animal, including a human. Such diagnostic assays advantageously allow for the testing of a subject's serum sample simultaneously for antibodies against all four serotypes.

The invention further provides methods of diagnosing or screening a composition, preferably a biological sample obtained from a subject (e.g., vertebrate, such as a mammal), such as blood or serum, for the presence or absence of one or more anti-flavivirus antibodies of one or more virus serotypes, including one or more antibodies against one or more flaviviruses or variants thereof that are closely related to one or more dengue viruses, and especially anti-dengue virus antibodies (including, e.g., antibodies against one or more dengue viruses or variants thereof). In one such aspect, the invention provides a method of diagnosing or screening a sample for the presence of one or more types of antibodies (or detecting in the composition the presence of one or more antibodies) that bind to at least one dengue virus of at least one serotype. The method comprises contacting a sample with a polypeptide of the invention under conditions such that if the sample comprises antibodies that bind to at least one dengue virus of at least one serotype at least one anti-dengue virus antibody binds to the polypeptide to form a mixed composition, contacting the mixed composition with at least one affinity-molecule that binds to an anti-dengue virus antibody, removing unbound affinity-molecule from the mixed composition, and detecting the presence or absence of affinity molecules in the composition, wherein the presence of an affinity molecule is indicative of the presence of antibodies in the sample that bind to the at least one dengue virus of the at least one serotype.

In another aspect, the invention provides a method of diagnosing, detecting in, identifying in, selecting from, or screening a sample for the presence of antibodies that bind or specifically bind to (or react with) at least one dengue virus of at least one serotype. In one aspect, such method comprises contacting a sample with a polypeptide of the invention under conditions such that if the sample comprises antibodies that bind to dengue virus at least one anti-dengue virus antibody binds to the polypeptide to form an antibody-polypeptide complex and detecting the presence or absence of an antibody-polypeptide complex, wherein the presence of an antibody-polypeptide complex is indicative of the presence of antibodies that bind to a dengue virus. In some such methods, the method comprises screening, detecting in, selecting from, or diagnosing a sample for the presence of antibodies that specifically bind to or specifically associate with a dengue virus of one or more serotypes. Preferably, the sample is a biological sample, preferably obtained from a mammal, which typically is suspected of and/or at risk for infection with one or more dengue viruses. Any suitable biological sample (i.e., that includes a sufficient quantity of antibodies for analysis, if present) can be used. Typically and preferably, serum from a mammal, typically a human, is obtained and used for such analysis. Alternatively, tissues where antibody concentrations are expected to be high, such as lymphoid tissues, can be analyzed.

The invention also includes an immunoassay for at least one dengue virus antibody which comprises the use of a polypeptide of the invention as a test sample. The above-described methods can further be modified to form any suitable type of immunoassay, examples of which are described above. Preferred immunoassays in this respect include dot blot assays, ELISA assays (e.g., competitive ELISA assays), and dipstick EIAs. In preparation of such assays, the polypeptide is bound (or associated with) a solid or semisolid matrix, to promote antigen-antibody complex formation. The detection of such antibody-antigen complexes is typically facilitated with a reagent suitable for visualization, such as dyes used in ELISA and FACS assays described elsewhere herein. Compositions comprising such elements are provided by the invention. For example, the invention provides a composition comprising at least one polypeptide of the invention bound to a solid matrix, and optionally including a reagent for visualizing an antibody bound to the polypeptide.

The invention also includes a kit for performing such an immunoassay comprising a composition of a polypeptide of the invention, bound to a solid matrix, in combination with a reagent suitable for visualization of antigen-antibody complexes after incubation of the matrix with a biological sample suspected of comprising anti-dengue virus antibodies.

A suitable substrate for performing an immunoassay to detect one or more anti-dengue virus antibodies in a sample composition is advantageously provided by obtaining cell free medium, aspirated from a culture of cells transformed with a polynucleotide of the invention (including a nucleic acid vector), or infected with a viral vector of the invention, which cells at least partially secrete a polypeptide of the invention into the cell medium such that the aspirated medium (supernatant) comprises a sufficient amount of polypeptide for use in the immunoassay. Remarkably, as little as about 10 µl of such a cell supernatant can be used as a substrate for a sensitive immunoassay, which is able to detect the presence of antibodies to dengue viruses of multiple serotypes, and, most preferably, to all four virus serotypes, preferably in a sample of serum obtained from a mammalian host (e.g., a human). The inventors contemplate the use of larger amounts of such supernatant (e.g., about 20 µl, about 50 µl, about 100 µl, or more), as well as the use of cell lysates of cells transfected with nucleic acids (or nucleic acid vectors) of the invention, as well as of cells infected with viral vectors of the invention. The supernatant can be associated with a matrix for performing EIAs (e.g., with an ELISA plate for ELISA assay or with a suitable membrane for dot blot assay) or can be directly used in an immunoprecipitation or other direct detection immunohistochemical technique. Similar techniques that can be modified with reference to the polypeptides of the invention are described in, e.g., U.S. Pat. No. 5,939,254 and other references cited herein.

The invention also includes a method of identifying the presence of antibodies to a flavivirus in a biological sample obtained from a subject, such as a mammal, comprising contacting at least one polypeptide of the invention (or composition comprising at least one such polypeptide and a carrier or a solid matrix) with a biological sample obtained from the subject under conditions such that an antibody capable of binding to a flavivirus in the biological sample binds to the polypeptide and forms an antibody-polypeptide complex; and detecting the presence of the antibody-polypeptide complex in the biological sample, thereby indicating the presence of antibodies in the biological sample (e.g., blood or serum).

Pools or libraries of two or more polypeptides of the invention also can be used in diagnosis techniques. Alternatively, a polypeptide of the invention can be added to a pool of other molecules (e.g., a pool of polypeptides, such as a collection of viral antigens). Thus, a library comprising two or more polypeptides of the invention is a feature of the invention. Another feature of the invention is a library of polypeptides of the invention (e.g., a collection of fragments of polypeptides of the invention or a collection of substantially identical polypeptides of the invention). The polypeptide(s) of the invention can be used in such libraries for diagnostic techniques (e.g., multiple diagnostic techniques for viral infection and/or other disease diagnosis). For example, a library of pathogenic antigens from pathogens associated with fever (or other disease states), comprising at least one polypeptide of the invention, can be used to diagnose infection of a mammal, preferably a human, by reaction of a biological sample obtained from the mammal with such a library in a manner that a detectable biological reaction between the sample and at least one component of the library will occur, thereby indicating what type of infection the mammal suffers from. The incorporation of one or more polypeptides of the invention in diagnostic chips ("protein chips") for such diagnostic techniques is a feature of the invention.

In another respect, the invention provides a polypeptide obtained by recursive sequence recombination (e.g., DNA shuffling and appropriate screening/selection methods) performed with a nucleic acid sequence of the invention (typically with multiple nucleic acid sequences of the invention and/or multiple wild-type flaviviral, preferably dengue virus, antigen-encoding sequences). For example, the invention provides a polypeptide obtained by a method of recursive sequence recombination that comprises recombining at least a first nucleic acid comprising a sequence selected from the group of SEQ ID NOS:169-174 and a second nucleic acid selected from the group of SEQ ID NOS:169-174 and 215-218, to produce a library of recombinant or synthetic nucleic acids, and screening the resulting library of recombinant or synthetic nucleic acids to identify at least one optimized nucleic acid that encodes a recombinant polypeptide that induces an immune response to at least a portion of dengue viruses of at least one virus serotype in a subject about equal to or greater than the immune response induced by a polypeptide encoded by the first nucleic acid, a polypeptide encoded by the second nucleic acid, or both. Typically, multiple nucleic acids selected from the first group and from the second group are used to generate or produce the library of nucleic acids.

In one embodiment, the invention provides a recombinant or synthetic polypeptide obtained by a method comprising: (a) recombining at least a first nucleic acid comprising a polynucleotide sequence selected from the group of SEQ ID NOS:211-214 and at least a second nucleic acid, wherein the at least first and second nucleic acids differ from each other in two or more nucleotides, to produce a library of recombinant or synthetic nucleic acids; (b) selecting from or screening the library of recombinant or synthetic nucleic acids to identify at least one recombinant or synthetic nucleic acid that encodes at least one recombinant or synthetic polypeptide that induces an immune response in a subject to at least one dengue virus of at least one serotype that is about equal to or greater than the immune response induced in the subject against said at least one dengue virus of said at least one serotype by the polypeptide encoded by the at least first nucleic acid or the at least second nucleic acid or both; and (c) expressing the at least one recombinant or synthetic nucleic acid to obtain the recombinant or synthetic polypeptide.

In another embodiment, the invention provides a recombinant or synthetic polypeptide obtained by a method comprising: (a) recombining at least a first nucleic acid comprising a polynucleotide sequence selected from the group of SEQ ID NOS:211-214 and at least a second nucleic acid, wherein the at least first and second nucleic acids differ from each other in two or more nucleotides, to produce a library of recombinant or synthetic nucleic acids; (b) selecting or screening the library of recombinant or synthetic nucleic acids to identify at least one recombinant or synthetic nucleic acid that encodes a recombinant or synthetic polypeptide that induces an immune response in a subject to at least one dengue virus of at least one serotype that is about equal to or greater than the immune response induced in the subject against said at least one dengue virus of said at least one serotype by a polypeptide encoded by the at least first nucleic acid and the at least second nucleic acid; (c) recombining the at least one recombinant or synthetic nucleic acid with at least a third nucleic acid comprising a sequence selected from the group of SEQ ID NOS:211-214, to produce a second library of recombinant or synthetic nucleic acid; (d) selecting from or screening the second library of recombinant or synthetic nucleic acids to identify at least one further recombinant or synthetic nucleic acid that encodes at least one further recombinant or synthetic polypeptide that induces an immune response to at least one dengue of at least one serotype in a subject that is about equal to or greater than the immune response induced in the subject against said at least one dengue virus of said at least one serotype by the polypeptide encoded by the at least first nucleic acid, the at least second nucleic acid, or the at least third nucleic acid, or any combination thereof; and (e) expressing the at least one further recombinant or synthetic to obtain the at least one further recombinant or synthetic polypeptide. Some such recombinant or synthetic polypeptides of the two embodiments above induce an immune response against the polypeptide encoded by the at least first nucleic acid and against the polypeptide encoded by the at least second nucleic acid in a subject. Further, some such recombinant or synthetic polypeptides of the two embodiments above induce an immune response against at least one dengue virus of each of dengue-1, dengue-2, dengue-3, and dengue-4 virus serotypes in a subject that is about equal to or greater than the immune response induced by the polypeptide encoded by the at least first nucleic acid, by the polypeptide encoded by the at least second nucleic acid, by the polypeptide encoded by the at least third nucleic acid, or by any combination thereof.

In another embodiment, the invention provides a recombinant or synthetic polypeptide obtained by a method comprising: (a) recombining at least a first nucleic acid comprising a polynucleotide sequence selected from the group of SEQ ID NOS:215-218, and at least a second nucleic acid, wherein the at least first and second nucleic acids differ from each other in two or more nucleotides, to produce a library of recombinant or synthetic nucleic acids; (b) selecting from or screening the library of recombinant or synthetic nucleic acids to identify at least one recombinant or synthesized nucleic acid that encodes at least one recombinant or synthetic polypeptide that induces an immune response to at least one dengue virus of at least one virus serotype in a subject that is about equal to or greater than the immune response induced against said at least one dengue virus of said at least one serotype by the polypeptide encoded by the at least first nucleic acid or the at least the second nucleic acid or both; and (c) expressing the at least one recombinant or synthetic nucleic acid to obtain the at least recombinant or synthetic polypeptide.

More generally, the polynucleotides of the invention and fragments thereof can be used as substrates for any of a variety of recombination and recursive sequence recombination reactions, in addition to their use in standard cloning methods as set forth in, e.g., Ausubel, Berger, and Sambrook, e.g., to produce additional polynucleotides or fragments thereof that encode recombinant dengue virus antigens having desired properties. A variety of such reactions are known, including those developed by the inventors and their co-workers.

A variety of diversity generating protocols for generating and identifying molecules of the invention having one of more of the properties described herein are available and described in the art. These procedures can be used separately, and/or in combination to produce one or more variants of a nucleic acid or set of nucleic acids, as well variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics. While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity-generating procedures described herein can be the generation of one or more nucleic acids, which can be selected or screened for nucleic acids with or which confer desirable properties, or that encode proteins with or which confer desirable properties. Following diversification by one or more of the methods herein, or otherwise available to one of skill, any nucleic acids that are produced can be selected for a desired activity or property described herein, including e.g., an ability to induce, promote, enhance, or modulate an immune response against at least one dengue virus of at least one serotype, T cell proliferation and/or activation, cytokine production (e.g., (e.g., IL-3 production and/or IFN-γ production), the production of antibodies that bind (react) with at least one flavivirus (e.g., dengue virus) of at least one serotype, preferably two, three or four serotypes in a subject, and/or the production of neutralizing antibodies against at least one flavivirus (such as a dengue virus) of at least one, and against at least one flavivirus of each of at least one, two, three or four serotypes in a subject. For example, the desired property may be the ability to induce, promote, modulate or enhance the production of neutralizing antibodies against at least one dengue virus of each of the dengue-1, dengue-2, dengue-3, and dengue-4 serotypes in a subject. This can include identifying any activity that can be detected, for example, in an automated or automatable format, by any of the assays in the art, such as the assays discussed herein and exemplified in the Examples in the Example section below. A variety of related (or even unrelated) properties can be evaluated, in serial or in parallel, at the discretion of the practitioner.

Descriptions of a variety of diversity generating procedures for generating modified nucleic acid sequences that encode polypeptides of the invention as described herein are found in the following publications and the references cited therein: Soong, N. et al. (2000) "Molecular breeding of viruses" *Nat Genet* 25(4):436-439; Stemmer, et al. (1999) "Molecular breeding of viruses for targeting and other clinical properties" *Tumor Targeting* 4:1-4; Ness et al. (1999)

"DNA Shuffling of subgenomic sequences of subtilisin" *Nature Biotechnology* 17:893-896; Chang et al. (1999) "Evolution of a cytokine using DNA family shuffling" *Nature Biotechnology* 17:793-797; Minshull and Stemmer (1999) "Protein evolution by molecular breeding" *Current Opinion in Chemical Biology* 3:284-290; Christians et al. (1999) "Directed evolution of thymidine kinase for AZT phosphorylation using DNA family shuffling" *Nature Biotechnology* 17:259-264; Crameri et al. (1998) "DNA shuffling of a family of genes from diverse species accelerates directed evolution" *Nature* 391:288-291; Crameri et al. (1997) "Molecular evolution of an arsenate detoxification pathway by DNA shuffling," *Nature Biotechnology* 15:436-438; Zhang et al. (1997) "Directed evolution of an effective fucosidase from a galactosidase by DNA shuffling and screening" *Proc. Natl. Acad. Sci. USA* 94:4504-4509; Patten et al. (1997) "Applications of DNA Shuffling to Pharmaceuticals and Vaccines" *Current Opinion in Biotechnology* 8:724-733; Crameri et al. (1996) "Construction and evolution of antibody-phage libraries by DNA shuffling" *Nature Medicine* 2:100-103; Crameri et al. (1996) "Improved green fluorescent protein by molecular evolution using DNA shuffling" *Nature Biotechnology* 14:315-319; Gates et al. (1996) "Affinity selective isolation of ligands from peptide libraries through display on a lac repressor 'headpiece dimer'" *Journal of Molecular Biology* 255: 373-386; Stemmer (1996) "Sexual PCR and Assembly PCR" In: *The Encyclopedia of Molecular Biology*. VCH Publishers, New York. pp.447-457; Crameri and Stemmer (1995) "Combinatorial multiple cassette mutagenesis creates all the permutations of mutant and wildtype cassettes" *BioTechniques* 18:194-195; Stemmer et al., (1995) "Single-step assembly of a gene and entire plasmid form large numbers of oligodeoxyribonucleotides" *Gene*, 164:49-53; Stemmer (1995) "The Evolution of Molecular Computation" *Science* 270: 1510; Stemmer (1995) "Searching Sequence Space" *Bio/Technology* 13:549-553; Stemmer (1994) "Rapid evolution of a protein in vitro by DNA shuffling" *Nature* 370:389-391; and Stemmer (1994) "DNA shuffling by random fragmentation and reassembly: In vitro recombination for molecular evolution." *Proc. Natl. Acad. Sci. USA* 91:10747-10751.

The term "shuffling" is used herein to indicate recombination between non-identical sequences, in some embodiments shuffling may include crossover via homologous recombination or via non-homologous recombination, such as via cre/lox and/or flp/frt systems. Shuffling can be carried out by employing a variety of different formats, including for example, in vitro and in vivo shuffling formats, in silico shuffling formats, shuffling formats that utilize either double-stranded or single-stranded templates, primer based shuffling formats, nucleic acid fragmentation-based shuffling formats, and oligonucleotide-mediated shuffling formats, all of which are based on recombination events between non-identical sequences and are described in more detail or referenced herein below, as well as other similar recombination-based formats.

Mutational methods of generating diversity include, for example, site-directed mutagenesis (Ling et al. (1997) "Approaches to DNA mutagenesis: an overview" *Anal Biochem*. 254(2): 157-178; Dale et al. (1996) "Oligonucleotide-directed random mutagenesis using the phosphorothioate method" *Methods Mol. Biol*. 57:369-374; Smith (1985) "In vitro mutagenesis" *Ann. Rev. Genet*. 19:423-462; Botstein & Shortle (1985) "Strategies and applications of in vitro mutagenesis" *Science* 229:1193-1201; Carter (1986) "Site-directed mutagenesis" *Biochem. J*. 237:1-7; and Kunkel (1987) "The efficiency of oligonucleotide directed mutagenesis" in *Nucleic Acids & Molecular Biology* (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" *Proc. Natl. Acad. Sci. USA* 82:488-492; Kunkel et al. (1987) "Rapid and efficient site-specific mutagenesis without phenotypic selection" *Methods in Enzymol*. 154, 367-382; and Bass et al. (1988) "Mutant Trp repressors with new DNA-binding specificities" *Science* 242:240-245); oligonucleotide-directed mutagenesis (*Methods in Enzymol*. 100: 468-500 (1983); *Methods in Enzymol*. 154: 329-350 (1987); Zoller & Smith (1982) "Oligonucleotide-directed mutagenesis using M13-derived vectors: an efficient and general procedure for the production of point mutations in any DNA fragment" *Nucleic Acids Res*. 10:6487-6500; Zoller & Smith (1983) "Oligonucleotide-directed mutagenesis of DNA fragments cloned into M13 vectors" *Methods in Enzymol*. 100: 468-500; and Zoller & Smith (1987) "Oligonucleotide-directed mutagenesis: a simple method using two oligonucleotide primers and a single-stranded DNA template" *Methods in Enzymol*. 154:329-350); phosphorothioate-modified DNA mutagenesis (Taylor et al. (1985) "The use of phosphorothioate-modified DNA in restriction enzyme reactions to prepare nicked DNA" *Nucl. Acids Res*. 13: 8749-8764; Taylor et al. (1985) "The rapid generation of oligonucleotide-directed mutations at high frequency using phosphorothioate-modified DNA" *Nucl. Acids Res*. 13: 8765-8787 (1985); Nakamaye & Eckstein (1986) "Inhibition of restriction endonuclease Nci I cleavage by phosphorothioate groups and its application to oligonucleotide-directed mutagenesis" *Nucl. Acids Res*. 14: 9679-9698; Sayers et al. (1988) "Y-T Exonucleases in phosphorothioate-based oligonucleotide-directed mutagenesis" *Nucl. Acids Res*. 16:791-802; and Sayers et al. (1988) "Strand specific cleavage of phosphorothioate-containing DNA by reaction with restriction endonucleases in the presence of ethidium bromide" *Nucl. Acids Res*. 16: 803-814); mutagenesis using gapped duplex DNA (Kramer et al. (1984) "The gapped duplex DNA approach to oligonucleotide-directed mutation construction" *Nucl. Acids Res*. 12: 9441-9456; Kramer & Fritz (1987) *Methods in Enzymol*. "Oligonucleotide-directed construction of mutations via gapped duplex DNA" 154:350-367; Kramer et al. (1988) "Improved enzymatic in vitro reactions in the gapped duplex DNA approach to oligonucleotide-directed construction of mutations" *Nucl. Acids Res*. 16: 7207; and Fritz et al. (1988) "Oligonucleotide-directed construction of mutations: a gapped duplex DNA procedure without enzymatic reactions in vitro" *Nucl. Acids Res*. 16: 6987-6999).

Additional suitable diversity-generating methods include point mismatch repair (Kramer et al. (1984) "Point Mismatch Repair" *Cell* 38:879-887), mutagenesis using repair-deficient host strains (Carter et al. (1985) "Improved oligonucleotide site-directed mutagenesis using M13 vectors" *Nucl. Acids Res*. 13: 4431-4443; and Carter (1987) "Improved oligonucleotide-directed mutagenesis using Ml 3 vectors" *Methods in Enzymol*. 154: 382-403), deletion mutagenesis (Eghtedarzadeh & Henikoff (1986) "Use of oligonucleotides to generate large deletions" *Nucl. Acids Res*. 14: 5115), restriction-selection and restriction-purification (Wells et al. (1986) "Importance of hydrogen-bond formation in stabilizing the transition state of subtilisin" *Phil. Trans. R. Soc. Lond. A* 317: 415-423), mutagenesis by total gene synthesis (Nambiar et al. (1984) "Total synthesis and cloning of a gene coding for the ribonuclease S protein" *Science* 223: 1299-1301; Sakamar and Khorana (1988) "Total synthesis and expression of a gene for the a-subunit of bovine rod outer segment guanine nucleotide-binding protein (transducin)" *Nucl. Acids Res*. 14: 6361-6372; Wells et al. (1985) "Cassette mutagenesis: an efficient method for generation of multiple mutations at defined sites" *Gene* 34:315-323; and Grundstrom et al. (1985) "Oligonucleotide-directed mutagenesis by microscale 'shotgun' gene synthesis" *Nucl. Acids Res.* 13: 3305-3316), double-strand break repair (Mandecki (1986) "Oligonucleotide-directed double-strand break repair in plasmids of *Escherichia coli*: a method for site-specific mutagenesis" *Proc. Natl. Acad. Sci. USA*, 83:7177-7181; and Arnold (1993) "Protein engineering for unusual environments" *Current Opinion in Biotechnology* 4:450-455). Additional details on many of the above methods can be found in *Methods in Enzymology* Volume 154, which also describes useful controls for trouble-shooting problems with various mutagenesis methods.

Additional site-mutagenesis techniques are described in, e.g., Edelman et al., *DNA*, 2, 183 (1983), Zoller et al., *Nucl. Acids Res.*, 10, 6487-5400 (1982), and Veira et al., *Meth. Enzymol.*, 153, 3 (1987)). Other useful mutagenesis techniques include alanine scanning, or random mutagenesis, such as iterated random point mutagenesis induced by error-prone PCR, chemical mutagen exposure, or polynucleotide expression in mutator cells (see, e.g., Bornscheueret et al., *Biotechnol. Bioeng.*, 58, 554-59 (1998), Cadwell and Joyce, *PCR Methods Appl.*, 3(6), S136-40 (1994), Kunkel et al., *Methods Enzymol.*, 204, 125-39 (1991), Low et al., *J. Mol. Biol.*, 260, 359-68 (1996), Taguchi et al., *Appl. Environ. Microbiol.*, 64(2), 492-95 (1998), and Zhao et al., *Nat. Biotech.*, 16, 258-61 (1998) for discussion of such techniques). Suitable primers for PCR-based site-directed mutagenesis or related techniques can be prepared by the methods described in, e.g., Crea et al., *Proc. Natl. Acad. Sci. USA*, 75, 5765 (1978).

Other useful techniques for promoting sequence diversity include PCR mutagenesis techniques (as described in, e.g., Kirsch et al., *Nucl. Acids Res.*, 26(7), 1848-50 (1998), Seraphin et al., *Nucl. Acids Res.*, 24(16), 3276-7 (1996), Caldwell et al., *PCR Methods Appl.*, 2(1), 28-33 (1992), Rice et al., *Proc. Natl. Acad. Sci. USA*. 89(12), 5467-71 (1992) and U.S. Pat. No. 5,512,463), cassette mutagenesis techniques based on the methods described in Wells et al., *Gene*, 34, 315 (1985), phagemid display techniques (as described in, e.g., Soumillion et al., *Appl. Biochem. Biotechnol.*, 47, 175-89 (1994), O'Neil et al., *Curr. Opin. Struct. Biol*, 5(4), 443-49 (1995), Dunn, *Curr. Opin. Biotechnol.*, 7(5), 547-53 (1996), and Koivunen et al., *J. Nucl. Med.*, 40(5), 883-88 (1999)), reverse translation evolution (as described in, e.g., U.S. Pat. No. 6,194,550), saturation mutagenesis described in, e.g., U.S. Pat. No. 6,171,820), PCR-based synthesis shuffling (as described in, e.g., U.S. Pat. No. 5,965,408) and recursive ensemble mutagenesis (REM) (as described in, e.g., Arkin and Yourvan, *Proc. Natl. Acad. Sci. USA*, 89, 7811-15 (1992), and Delgrave et al., *Protein Eng.*, 6(3), 327-331 (1993)). Techniques for introducing diversity into a library of homologous sequences also are provided in U.S. Pat. Nos. 6,159,687 and 6,228,639.

Further details regarding various diversity generating methods can be found in the following U.S. patents, PCT publications and applications, and EPO publications: U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41622 by Borchert et al., "Method for Constructing a Library Using DNA Shuffling," and WO 98/42727 by Pati and Zarling, "Sequence Alterations using Homologous Recombination;" WO 00/18906 by Patten et al., "Shuffling of Codon-Altered Genes;" WO 00/04190 by del Cardayre et al. "Evolution of Whole Cells and Organisms by Recursive Recombination;" WO 00/42561 by Crameri et al., "Oligonucleotide Mediated Nucleic Acid Recombination;" WO 00/42559 by Selifonov and Stemmer "Methods of Populating Data Structures for Use in Evolutionary Simulations;" WO 00/42560 by Selifonov et al., "Methods for Making Character Strings, Polynucleotides & Polypeptides Having Desired Characteristics;" PCT/US00/26708 by Welch et al., "Use of Codon-Varied Oligonucleotide Synthesis for Synthetic Shuffling;" and PCT/US01/06775 "Single-Stranded Nucleic Acid Template-Mediated Recombination and Nucleic Acid Fragment Isolation" by Affholter.

Several different general classes of sequence modification methods, such as mutation, recombination, etc. are applicable to the present invention and set forth, e.g., in the references above and below. The following exemplify some of the different types of preferred formats for diversity generation in the context of the present invention, including, e.g., certain recombination based diversity generation formats.

Nucleic acids can be recombined in vitro by any of a variety of techniques discussed in the references above, including e.g., DNAse digestion of nucleic acids to be recombined followed by ligation and/or PCR reassembly of the nucleic acids. For example, sexual PCR mutagenesis can be used in which random (or pseudo random, or even non-random) fragmentation of the DNA molecule is followed by recombination, based on sequence similarity, between DNA molecules with different but related DNA sequences, in vitro, followed by fixation of the crossover by extension in a polymerase chain reaction. This process and many process variants is described in several of the references above, e.g., in Stemmer (1994) *Proc. Natl. Acad. Sci. USA* 91:10747-10751.

Similarly, nucleic acids can be recursively recombined in vivo, e.g., by allowing recombination to occur between nucleic acids in cells. Many such in vivo recombination formats are set forth in the references noted above. Such formats optionally provide direct recombination between nucleic acids of interest, or provide recombination between vectors, viruses, plasmids, etc., comprising the nucleic acids of interest, as well as other formats. Details regarding such procedures are found in the references noted above. Whole genome recombination methods can also be used in which whole genomes of cells or other organisms are recombined, optionally including spiking of the genomic recombination mixtures with desired library components (e.g., genes corresponding to the pathways of the present invention). These methods have many applications, including those in which the identity of a target gene is not known. Details on such methods are found, e.g., in WO 98/31837 by del Cardayre et al. "Evolution of Whole Cells and Organisms by Recursive Sequence Recombination;" and in, e.g., PCT/US99/15972 by del Cardayre et al., also entitled "Evolution of Whole Cells and Organisms by Recursive Sequence Recombination."

Synthetic recombination methods can also be used in which oligonucleotides corresponding to targets of interest are synthesized and reassembled in PCR or ligation reactions which include oligonucleotides which correspond to more than one parental nucleic acid, thereby generating new recombined nucleic acids. Oligonucleotides can be made by standard nucleotide addition methods, or can be made, e.g., by tri-nucleotide synthetic approaches. Details regarding such approaches are found in the references noted above, including, e.g., WO 00/42561 by Crameri et al., "Oligonucleotide Mediated Nucleic Acid Recombination;" PCT/US00/26708 by Welch et al., "Use of Codon-Varied Oligonucleotide Synthesis for Synthetic Shuffling;" WO 00/42560 by Selifonov et al., "Methods for Making Character Strings, Polynucleotides and Polypeptides Having Desired Characteristics;" and WO 00/42559 by Selifonov and Stemmer "Methods of Populating Data Structures for Use in Evolutionary Simulations."

In silico methods of recombination can be effected in which genetic algorithms are used in a computer to recombine sequence strings that correspond to homologous (or even non-homologous) nucleic acids. The resulting recombined sequence strings are optionally converted into nucleic acids by synthesis of nucleic acids that correspond to the recombined sequences, e.g., in concert with oligonucleotide synthesis/gene reassembly techniques. This approach can generate random, partially random or designed variants. Many details regarding in silico recombination, including the use of genetic algorithms, genetic operators and the like in computer systems, combined with generation of corresponding nucleic acids (and/or proteins), as well as combinations of designed nucleic acids and/or proteins (e.g., based on cross-over site selection) as well as designed, pseudo-random or random recombination methods are described in WO 00/42560 by Selifonov et al., "Methods for Making Character Strings, Polynucleotides and Polypeptides Having Desired Characteristics" and WO 00/42559 by Selifonov and Stemmer "Methods of Populating Data Structures for Use in Evolutionary Simulations." Extensive details regarding in silico recombination methods are found in these applications. This methodology is generally applicable to the nucleic acid sequences and polypeptide sequences of the invention.

Many methods of accessing natural diversity, e.g., by hybridization of diverse nucleic acids or nucleic acid fragments to single-stranded templates, followed by polymerization and/or ligation to regenerate full-length sequences, optionally followed by degradation of the templates and recovery of the resulting modified nucleic acids can be similarly used. In one method employing a single-stranded template, the fragment population derived from the genomic library(ies) is annealed with partial, or, often approximately full length ssDNA or RNA corresponding to the opposite strand. Assembly of complex chimeric genes from this population is then mediated by nuclease-base removal of non-hybridizing fragment ends, polymerization to fill gaps between such fragments and subsequent single stranded ligation. The parental polynucleotide strand can be removed by digestion (e.g., if RNA or uracil-containing), magnetic separation under denaturing conditions (if labeled in a manner conducive to such separation) and other available separation/purification methods. Alternatively, the parental strand is optionally co-purified with the chimeric strands and removed during subsequent screening and processing steps. Additional details regarding this approach are found, e.g., in "Single-Stranded Nucleic Acid Template-Mediated Recombination and Nucleic Acid Fragment Isolation" by Affholter, PCT/US01/06775.

In another approach, single-stranded molecules are converted to double-stranded DNA (dsDNA) and the dsDNA molecules are bound to a solid support by ligand-mediated binding. After separation of unbound DNA, the selected DNA molecules are released from the support and introduced into a suitable host cell to generate a library enriched sequences, which hybridize to the probe. A library produced in this manner provides a desirable substrate for further diversification using any of the procedures described herein.

Any of the preceding general recombination formats can be practiced in a reiterative fashion (e.g., one or more cycles of mutation/recombination or other diversity generation methods, optionally followed by one or more selection methods) to generate a more diverse set of recombinant nucleic acids.

Mutagenesis employing polynucleotide chain termination methods have also been proposed (see e.g., U.S. Pat. No. 5,965,408, "Method of DNA reassembly by interrupting synthesis" to Short, and the references above), and can be applied to the present invention. In this approach, double stranded DNAs corresponding to one or more genes sharing regions of sequence similarity are combined and denatured, in the presence or absence of primers specific for the gene. The single stranded polynucleotides are then annealed and incubated in the presence of a polymerase and a chain terminating reagent (e.g., ultraviolet, gamma or X-ray irradiation; ethidium bromide or other intercalators; DNA binding proteins, such as single strand binding proteins, transcription activating factors, or histones; polycyclic aromatic hydrocarbons; trivalent chromium or a trivalent chromium salt; or abbreviated polymerization mediated by rapid thermocycling; and the like), resulting in the production of partial duplex molecules. The partial duplex molecules, e.g., comprising partially extended chains, are then denatured and re-annealed in subsequent rounds of replication or partial replication resulting in polynucleotides which share varying degrees of sequence similarity and which are diversified with respect to the starting population of DNA molecules. Optionally, the products, or partial pools of the products, can be amplified at one or more stages in the process. Polynucleotides produced by a chain termination method, such as described above, are suitable substrates for any other described recombination format.

Diversity also can be generated in nucleic acids or populations of nucleic acids using a recombination procedure known as "incremental truncation for the creation of hybrid enzymes" ("ITCHY") described in Ostemeier et al. (1999) "A combinatorial approach to hybrid enzymes independent of DNA homology" *Nature Biotech* 17:1205. This approach can be used to generate an initial a library of variants, which can optionally serve as a substrate for one or more in vitro or in vivo recombination methods. See, also, Ostemeier et al. (1999) "Combinatorial Protein Engineering by Incremental Truncation," *Proc. Natl. Acad. Sci. USA*, 96: 3562-67; Ostermeier et al. (1999), "Incremental Truncation as a Strategy in the Engineering of Novel Biocatalysts," *Biological and Medicinal Chemistry*, 7: 2139-44.

Mutational methods which result in the alteration of individual nucleotides or groups of contiguous or non-contiguous nucleotides can be favorably employed to introduce nucleotide diversity. Many mutagenesis methods are found in the above-cited references; additional details regarding mutagenesis methods can be found in following, which can also be applied to the present invention. For example, error-prone PCR can be used to generate nucleic acid variants. Using this technique, PCR is performed under conditions where the copying fidelity of the DNA polymerase is low, such that a high rate of point mutations is obtained along the entire length of the PCR product. Examples of such techniques are found in the references above and, e.g., in Leung et al. (1989) *Technique* 1:11-15 and Caldwell et al. (1992) *PCR Methods Applic.* 2:28-33. Similarly, assembly PCR can be used, in a process which involves the assembly of a PCR product from a mixture of small DNA fragments. A large number of different PCR reactions can occur in parallel in the same reaction mixture, with the products of one reaction priming the products of another reaction.

Oligonucleotide directed mutagenesis can be used to introduce site-specific mutations in a nucleic acid sequence of interest. Examples of such techniques are found in the references above and, e.g., in Reidhaar-Olson et al. (1988) *Science*, 241:53-57. Cassette mutagenesis can be used in a process that replaces a small region of a double stranded DNA molecule with a synthetic oligonucleotide cassette that differs from the native sequence. The oligonucleotide can include, e.g., completely and/or partially randomized native sequence(s).

Recursive ensemble mutagenesis is a process in which an algorithm for protein mutagenesis is used to produce diverse populations of phenotypically related mutants, members of which differ in amino acid sequence. This method uses a feedback mechanism to monitor successive rounds of combinatorial cassette mutagenesis. Examples of this approach are found in Arkin & Youvan (1992) *Proc. Natl. Acad. Sci. USA* 89:7811-7815. Exponential ensemble mutagenesis can be used for generating combinatorial libraries with a high percentage of unique and functional mutants. Small groups of residues in a sequence of interest are randomized in parallel to identify, at each altered position, amino acids which lead to functional proteins. Examples of such procedures are in Delegrave & Youvan (1993) *Biotechnology Research* 11:1548-1552.

In vivo mutagenesis can be used to generate random mutations in any cloned DNA of interest by propagating the DNA, e.g., in a strain of *E. coli* that carries mutations in one or more of the DNA repair pathways. These "mutator" strains have a higher random mutation rate than that of a wild-type parent. Propagating the DNA in one of these strains will eventually generate random mutations within the DNA. Such procedures are described in the references noted above. Alternatively, in vivo recombination techniques can be used. For example, a multiplicity of monomeric polynucleotides sharing regions of partial sequence similarity can be transformed into a host species and recombined in vivo by the host cell. Subsequent rounds of cell division can be used to generate libraries, members of which, include a single, homogenous population, or pool of monomeric polynucleotides. Alternatively, the monomeric nucleic acid can be recovered by standard techniques, e.g., PCR and/or cloning, and recombined in any of the recombination formats, including recursive recombination formats, described above. Other techniques that can be used for in vivo recombination and sequence diversification are described in U.S. Pat. No. 5,756,316.

Methods for generating multispecies expression libraries have been described (in addition to the reference noted above, see, e.g., Peterson et al. (1998) U.S. Pat. No. 5,783,431 "METHODS FOR GENERATING AND SCREENING NOVEL METABOLIC PATHWAYS," and Thompson, et al. (1998) U.S. Pat. No. 5,824,485 METHODS FOR GENERATING AND SCREENING NOVEL METABOLIC PATHWAYS) and their use to identify protein activities of interest has been proposed (In addition to the references noted above, see Short (1999) U.S. Pat. No. 5,958,672 "PROTEIN ACTIVITY SCREENING OF CLONES HAVING DNA FROM UNCULTIVATED MICROORGANISMS"). Multispecies expression libraries include, in general, libraries comprising cDNA or genomic sequences from a plurality of species or strains, operably linked to appropriate regulatory sequences, in an expression cassette. The cDNA and/or genomic sequences are optionally randomly ligated to further enhance diversity. The vector can be a shuttle vector suitable for transformation and expression in more than one species of host organism, e.g., bacterial species, eukaryotic cells. In some cases, the library is biased by preselecting sequences which encode a protein of interest, or which hybridize to a nucleic acid of interest. Any such libraries can be provided as substrates for any of the methods herein described.

The polynucleotide sequences of the present invention can be engineered by standard techniques to make additional modifications, such as, the insertion of new restriction sites, the alteration of glycosylation patterns, the alteration of pegylation patterns, modification of the sequence based on host cell codon preference, the introduction of recombinase sites, and the introduction of splice sites.

In some applications, it is desirable to preselect or pre-screen libraries (e.g., an amplified library, a genomic library, a cDNA library, a normalized library, etc.) or other substrate nucleic acids prior to diversification, e.g., by recombination-based mutagenesis procedures, or to otherwise bias the substrates towards nucleic acids that encode functional products. Libraries can also be biased towards nucleic acids which have specified characteristics, e.g., hybridization to a selected nucleic acid probe.

"Non-Stochastic" methods of generating nucleic acids and polypeptides are alleged in Short "Non-Stochastic Generation of Genetic Vaccines and Enzymes" WO 00/46344. These methods, including proposed non-stochastic polynucleotide reassembly and site-saturation mutagenesis methods are applicable to the present invention as well. Random or semi-random mutagenesis using doped or degenerate oligonucleotides is also described in, e.g., Arkin and Youvan (1992) "Optimizing nucleotide mixtures to encode specific subsets of amino acids for semi-random mutagenesis" *Biotechnology* 10:297-300; Reidhaar-Olson et al. (1991) "Random mutagenesis of protein sequences using oligonucleotide cassettes" *Methods Enzymol.* 208:564-86; Lim and Sauer (1991) "The role of internal packing interactions in determining the structure and stability of a protein" *J. Mol. Biol.* 219:359-76; Breyer and Sauer (1989) "Mutational analysis of the fine specificity of binding of monoclonal antibody 51F to lambda repressor" *J. Biol. Chem.* 264:13355-60); and "Walk-Through Mutagenesis" (U.S. Pat. Nos. 5,830,650 and 5,798,208, and European Patent 0 527 809).

It will readily be appreciated that any of the above described techniques suitable for enriching a library prior to diversification can also be used to screen the products, or libraries of products, produced by the diversity generating methods.

Kits for mutagenesis, library construction and other diversity generation methods are also commercially available. For example, kits are available from, e.g., Stratagene (e.g., Quick-Change™ site-directed mutagenesis kit; and Chameleon™ double-stranded, site-directed mutagenesis kit), Bio/Can Scientific, Bio-Rad (e.g., using the Kunkel method described above), Boehringer Mannheim Corp., Clonetech Laboratories, DNA Technologies, Epicentre Technologies (e.g., 5 prime 3 prime kit); Genpak Inc, Lemargo Inc, Life Technologies (Gibco BRL), New England Biolabs, Pharmacia Biotech, Promega Corp., Quantum Biotechnologies, Amersham International plc (e.g., using the Eckstein method above), and Anglian Biotechnology Ltd (e.g., using the Carter/Winter method above).

The above references provide many mutational formats, including recombination, recursive recombination, recursive mutation and combinations or recombination with other forms of mutagenesis, as well as many modifications of these formats. Regardless of the diversity generation format that is used, the nucleic acids of the invention can be recombined (with each other, or with related (or even unrelated) sequences) to produce a diverse set of recombinant nucleic acids, including, e.g., sets of homologous nucleic acids, as well as corresponding polypeptides.

A recombinant nucleic acid produced by recombining one or more polynucleotide sequences of the invention with one or more additional nucleic acids using any of the above-described formats alone or in combination forms a part of the invention. The one or more additional nucleic acids may include another polynucleotide of the invention; optionally, alternatively, or in addition, the one or more additional nucleic acid can include, e.g., a nucleic acid encoding a naturally-occurring dengue virus prM and/or E protein-encoding sequence, a prM and/or E sequence of another flavivirus, or, e.g., any other homologous or non-homologous nucleic acid or fragments thereof (certain recombination formats noted above, notably those performed synthetically or in silico, do not require homology for efficient recombination).

Desirably, the recombinant polypeptides obtained by the above-described recombination methods are functional chimeric polypeptides. For example, a polypeptide produced by one of the above-described methods often and desirably induces an immune response against a polypeptide encoded by the first nucleic acid as well as against a polypeptide encoded by the second nucleic acid in a subject. Because multiple, preferably at least three, and more preferably, at least four, or more, nucleic acids are used in the recursive sequence recombination techniques of the invention, a polypeptide obtained from a nucleic acid product of such recombination reactions typically comprises two or more peptide fragments or peptide portions unique to a polypeptide encoded by one of the parental sequences. Each such peptide fragment or peptide portion is an amino acid sequence of one or more contiguous amino acids, usually at least about 10, at least about 15, at least about 20, or at least about 30 or more amino acids in length. Such peptide fragments or peptide portions can be identified by sequence analysis techniques. Examples of peptides of the invention having such sequence diversity (or complex chimerism) are described in the Examples section below. The unique peptide fragments or peptide portions corresponding to any particular peptide encoded by a parental sequence are separated from each other by peptide fragments or peptide portions, respectively, corresponding to peptides encoded by other parental nucleic acids. The parental peptide fragments or portions can be any suitable size. Typically, a parental peptide fragment or portion comprises at least about 10, at least about 15, at least about 20, and at least about 30 or more amino acids in length. Multiple peptide fragments or peptide portions desirably include epitopes present in the peptides encoded by the parental nucleic acids. In this respect, a polypeptide expressed from a recombinant nucleotide sequence of the invention desirably comprises at least about one, two, or more T-cell epitopes and/or antigenic sequences also present in the polypeptide encoded by at least one parental nucleic acid, and, more preferably, by each parental nucleic acid. Of course, recombination also can result in novel coding sequences not present in any of the parental nucleic acid sequences, and, as such, produce novel epitopes not observed in any of the parental nucleic acid sequences.

Polynucleotides produced by the above-described recombination, mutagenesis, and standard nucleotide synthesis techniques can be screened for any suitable characteristic, such as the expression of a recombinant polypeptide having any of the desirable characteristics attendant the novel dengue virus antigens of the invention, which are discussed in detail elsewhere herein. Polypeptides produced by such techniques and having such characteristics are an important feature of the invention. For example, the invention provides a recombinant polypeptide encoded by a recombinant polynucleotide produced by recursive sequence recombination with any nucleic acid sequence of the invention that induces an immune response against one or more dengue viruses of one, two, three, or preferably four virus serotypes in a subject. Preferably, the immune response induced by administration or expression of such a polypeptide in the subject is about equal to or greater than the immune response induced by a polypeptide encoded by the first nucleic acid, the immune response induced by a polypeptide encoded by the second nucleic acid, or both.

A polypeptide of the invention can comprise any suitable number of non-dengue virus antigen peptide fragments. Correspondingly, a polynucleotide of the invention can comprise any suitable number of nucleic acid fragments encoding such non-dengue virus antigen peptide fragments. Such peptide fragments are typically fused to the C or N terminus of a polypeptide of the invention, as desired, to form a fusion protein. Such fusion proteins are an important feature of the invention. In general, the invention provides a polypeptide having any of the above-described characteristics of the invention, that further includes a heterologous fusion partner (non dengue-antigen encoding peptide fragment or peptide portion), that exhibits at least one biological property that is separately detectable from the rest of the polypeptide in a subject. Numerous types of heterologous fusion partners can be incorporated into the polypeptide in addition to the immunogenic amino acid sequence (and optional signal sequence) of the invention described above.

A particularly useful fusion partner is a peptide fragment or peptide portion that facilitates purification of the polypeptide ("polypeptide purification subsequence"). Several types of suitable polypeptide purification subsequences are known in the art. Examples of such fusion partners include a polyhistidine sequence, histidine-tryptophan modules that allow purification on immobilized metals, such as a hexa-histidine peptide, a sequence encoding such a tag is incorporated in the pQE vector available from QIAGEN, Inc. (Chatsworth, Calif.), a sequence which binds glutathione (e.g., glutathione-S-transferase (GST)), a hemagglutinin (HA) tag (corresponding to an epitope derived from the influenza hemagglutinin protein; Wilson, I. et al. (1984) *Cell* 37:767), maltose binding protein sequences, the FLAG epitope utilized in the FLAGS extension/affinity purification system (Immunex Corp, Seattle, Wash.)—commercially available FLAG epitopes also are available through Kodak (New Haven, Conn.), thioredoxin (TRX), avidin, and the like. The inclusion of a protease-cleavable polypeptide linker sequence between the purification domain and the immunogenic amino acid sequence or immunogenic amino acid sequence/signal sequence portion of the polypeptide is useful to facilitate purification of an immunogenic fragment of the fusion protein. Histidine residues facilitate purification on IMIAC (immobilized metal ion affinity chromatography, as described in Porath et al. (1992) *Protein Expression and Purification* 3:263-281) while the enterokinase cleavage site provides a method for separating the polypeptide from the fusion protein. pGEX vectors (Promega; Madison, Wis.) conveniently can be used to express foreign polypeptides as fusion proteins with glutathione S-transferase (GST). Additional examples of such sequences and the use thereof for protein purification are described in, e.g., International Patent Application WO 00/15823. After expression of the polypeptide and isolation thereof by such fusion partners or otherwise (as described above), protein refolding steps can be used, as desired, in completing configuration of the mature polypeptide.

A fusion protein of the invention also can include one or more additional peptide fragments or peptide portions which promote detection of the fusion protein. For example, a reporter peptide fragment or portion (e.g., green fluorescent protein (GFP), β-galactosidase, or a detectable domain thereof) can be incorporated in the fusion protein. Additional marker molecules that can be conjugated to the polypeptide of the invention include radionuclides, enzymes, fluorophores, small molecule ligands, and the like.

A polypeptide of the invention can further be modified by the inclusion of at least one modified amino acid. The inclusion of one or more modified amino acids may be advantageous in, for example, (a) increasing polypeptide serum half-life, (b) reducing polypeptide antigenicity, or (c) increasing polypeptide storage stability. Amino acid(s) are modified, for example, co-translationally or post-translationally during recombinant production (e.g., N-linked glycosylation at N-X-S/T motifs during expression in mammalian cells) or modified by synthetic means. Non-limiting examples of a modified amino acid include a glycosylated amino acid, a sulfated amino acid, a prenlyated (e.g., farnesylated, geranylgeranylated) amino acid, an acetylated amino acid, an acylated amino acid, a PEG-ylated amino acid, a biotinylated amino acid, a carboxylated amino acid, a phosphorylated amino acid, and the like. References adequate to guide one of skill in the modification of amino acids are replete throughout the literature. Example protocols are found in Walker (1998) Protein Protocols on CD-ROM Humana Press, Towata, N.J. Preferably, the modified amino acid is selected from a glycosylated amino acid, a PEGylated amino acid, a farnesylated amino acid, an acetylated amino acid, a biotinylated amino acid, an amino acid conjugated to a lipid moiety, and an amino acid conjugated to an organic derivatizing agent.

Another feature of the invention is a polypeptide comprising an immunogenic amino acid sequence as described above and further comprising a targeting sequence other than, or in addition to, a signal sequence. For example, the polypeptide can comprise a sequence that targets a receptor on a particular cell type (e.g., a monocyte, dendritic cell, or associated cell) to provide targeted delivery of the polypeptide to such cells and/or related tissues. Signal sequences are described above, and include membrane localization/anchor sequences (e.g., stop transfer sequences, GPI anchor sequences), and the like.

In another aspect, the polypeptide can comprise a fusion partner that promotes stability of the polypeptide, secretion of the polypeptide (other than by signal targeting), or both. For example, the polypeptide can comprise an immunoglobulin (Ig) domain, such as an IgG polypeptide comprising an Fc hinge, a CH2 domain, and a CH3 domain, that promotes stability and/or secretion of the polypeptide.

A fusion protein of the invention can further include additional immunogenic amino acid sequences. For example, the fusion protein can comprise an amino acid sequence that has substantial identity (e.g., at least about 75%, 80%, 85%, 86%, 87%, 88% or 89%, preferably at least about 90%, 91%, 92%, 93%, 94%, 95%, 96% 97%, 98%, 99%, 99.5% sequence identity) with a sequence fragment or portion of a flavivirus capsid protein, preferably a dengue virus capsid protein (e.g., DEN-2 or DEN-4), of at least about 20 amino acids in length. For example, the polypeptide can comprise a fusion protein of an immunogenic amino acid sequence of the invention and a yellow fever virus or adenovirus envelope, capsid, or other protein. Alternatively or additionally, a polypeptide of the invention (or polynucleotide encoding a polypeptide of the invention) can be administered with one or more dengue capsid proteins, or portions or fragments of such proteins, such as a portion or fragment of a dengue capsid comprising a T cell epitope (examples of such epitopes are known in the art (see, e.g., Gagnon et al. *J. Virol*, 70(1):141-147 (1996)), or one or more polynucleotides encoding such polypeptides or peptides. The polypeptide also or alternatively can comprise, or be administered with one or more dengue virus nonstructural proteins, or one or more nucleic acids encoding such proteins or substantially identical peptides (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity). For example, the addition of a non-structural protein (e.g., NS1, NS2A, NS2B, NS3, NS4A, NS4B, and/or NS5 proteins) may increase a T cell response, if it includes one or more additional T cell epitopes. The invention includes polypeptides that have at least about 80%, 85%, 90% or more sequence identity to a WT NS dengue virus protein and uses of such polypeptides as described herein. The co-delivery of polypeptides comprising nonstructural protein B cell and/or T cell epitopes (like those found in Ni (also referred to as NS-1 or NS1), N3 (NS-3 or NS3), or N5 (NS-5 or NS5)—see, e.g., Mathew et al. *J Clin Invest*, 98(7):1684-1692 (1996), Okamoto et al. *J Gen Virol* 79:697-704 (1998), Green et al., *Virology* 234(2):383-386 (1997), and Garcia et al. *Am J Trop Med Hyg* 56(4):466-70 (1997)), or co-expression of sequences encoding at least one such polypeptide, can improve the level of the multivalent immune response induced by the delivery and/or expression of the recombinant polypeptides of the invention in subjects, such as mammals.

The fusion protein peptide fragments or peptide portions can be associated in any suitable manner. Typically and preferably, the first and second peptide fragments or portions are covalently associated (e.g., by means of a peptide or disulfide bond). The peptide fragments or portions can be directly fused (e.g., the C-terminus of the immunogenic amino acid sequence can be fused to the N-terminus of a purification sequence or heterologous immunogenic sequence). The fusion protein can include any suitable number of modified bonds, e.g., isosteres, within or between the peptide portions. Alternatively, the fusion protein can include a peptide linker between the peptide fragments or portions that includes one or more amino acid sequences not forming part of the biologically active peptide portions. Any suitable peptide linker can be used. The linker can be any suitable size. Typically, the linker is less than about 30 amino acid residues, preferably less than about 20 amino acid residues, and more preferably about 10 or less than 10 amino acid residues. Typically, the linker predominantly comprises or consists of neutral amino acid residues. Suitable linkers are generally described in, e.g., U.S. Pat. Nos. 5,990,275, 6,010,883, 6,197,946, and European Patent Application 0 035 384. If separation of peptide fragments or peptide portions is desirable a linker that facilitates separation can be used. An example of such a linker is described in U.S. Pat. No. 4,719,326. "Flexible" linkers, which are typically composed of combinations of glycine and/or serine residues, can be advantageous. Examples of such linkers are described in, e.g., McCafferty et al., *Nature*, 348, 552-554 (1990), Huston et al., Proc. Natl. Acad. Sci. USA, 85, 5879-5883 (1988), Glockshuber et al., *Biochemistry*, 29, 1362-1367 (1990), and Cheadle et al., *Molecular Immunol.*, 29, 21-30 (1992), Huston et al., *Proc. Natl. Acad. Sci. USA*, 85, 5879-5883 (1988), Bird et al., *Science*, 242, 423-26 (1988), and U.S. Pat. Nos. 5,672,683, 6,165,476, and 6,132,992.

The use of a linker also can reduce undesired immune response to the fusion protein created by the fusion of the two peptide fragments or peptide portions, which can result in an unintended MHC I and/or MHC II epitope being present in the fusion protein. In addition to the use of a linker, identified undesirable epitope sequences or adjacent sequences can be PEGylated (e.g., by insertion of lysine residues to promote PEG attachment) to shield identified epitopes from exposure. Other techniques for reducing immunogenicity of the fusion protein of the invention can be used in association with the administration of the fusion protein include the techniques provided in U.S. Pat. No. 6,093,699.

A recombinant polypeptide of the invention also desirably does not comprise irrelevant epitopes (i.e., non-dengue relevant epitopes) or inter-epitope junctions. Such techniques also can be used to prevent presentation of irrelevant epitopes and epitope-junctions. Techniques for analyzing epitopes are further provided in the Examples section, which can be used to rationally design recombinant antigens without such irrelevant and/or undesired epitopes.

Fragments of polypeptides of the invention also can be useful in promoting an immune response to a dengue virus in a subject. The invention provides such fragments and methods of use thereof. For example, the invention provides a fragment of a polypeptide of the invention that is at least about 75 amino acids in length, and is not identical to a fragment of a wild-type envelope protein or wild-type prM/E protein of DEN-1, DEN-2, DEN-3, or DEN-4, wherein the fragment induces an immune response to at least one dengue virus of at least one serotype in a subject. Particular polypeptide fragments induce an immune response to one or more dengue viruses of multiple serotypes (e.g., two, three, or all four known serotypes), including a neutralizing antibody response to one or more dengue viruses of each of two, three or four serotypes, and most preferably induce a protective immune response against one or more dengue viruses of each of two, three or four serotypes when administered or expressed appropriately in a subject.

In addition to encoding and expressing recombinant immunogenic polypeptides of the invention, the nucleic acids also can be useful for sense and anti-sense suppression of expression (e.g., to control expression levels in tissues away from those in which expression of an administered nucleic acid or vector is desired). A variety of sense and anti-sense technologies are known in the art, see, e.g., Lichtenstein & Nellen (1997) ANTISENSE TECHNOLOGY: A PRACTICAL APPROACH IRL Press at Oxford University, Oxford, England, Agrawal (1996) ANTISENSE THERAPEUTICS Humana Press, NJ, and references cited therein.

The invention further provides nucleic acids that comprise a nucleic acid sequence that is the substantial complement (i.e., comprises a sequence that complements at least about 90%, preferably at least about 95%), and more preferably the complement, of any of the above-described nucleic acid sequences. Such complementary nucleic acid sequences are useful in probes, production of the nucleic acid sequences of the invention, and as antisense nucleic acids for hybridizing to nucleic acids of the invention. Short oligonucleotide sequences comprising sequences that complement the nucleic acid, e.g., of about 15, 20, 30, or 50 bases (preferably at least about 12 bases), which hybridize under highly stringent conditions to a nucleic acid of the invention are useful as probes (e.g., to determine the presence of a nucleic acid of the invention in a particular cell or tissue and/or to facilitate the purification of nucleic acids of the invention). Polynucleotides comprising complementary sequences also can be used as primers for amplification of the nucleic acids of the invention.

The invention further provides a fragment of a nucleic acid of the invention that comprises a sequence that encodes a unique subsequence in a polypeptide selected from the group of SEQ ID NOS:1-49 and 153-155 as compared to any of SEQ ID NOS:338-341. Also provided is a fragment of a nucleic acid of the invention that comprises a sequence that encodes a unique subsequence in a polypeptide selected from the group of SEQ ID NOS:65-116 as compared to any of SEQ ID NOS:149-152. Also provided is a fragment of a nucleic acid of the invention that comprises a sequence that encodes a unique subsequence in a polypeptide selected from the group of SEQ ID NOS:139-148, 236-253, 343, and 345 as compared to any of SEQ ID NOS:227-230.

The invention also provides a fragment of a nucleic acid of the invention that comprises a unique sequence of nucleotides of at least about 300, preferably at least about 400, more preferably at least about 600, desirably at least about 900, and more desirably at least about 1200 nucleotides from a sequence selected from any of SEQ ID NOS:285-330, as compared to a wild-type dengue tE-polypeptide encoding sequence selected from any of SEQ ID NOS:338-341 and similar known dengue virus truncated E polypeptide-encoding nucleotide sequences, including those available in Gen-Bank, and more preferably as compared to any known wild-type flaviviral truncated E polypeptide-encoding nucleotide sequence. Such fragment induces an immune response to at least one dengue virus of at least one serotype in a subject when administered and is useful in, among other things, methods of inducing an immune response in the subject and cells thereof against such at least one dengue virus (e.g., neutralizing Ab response against at least one dengue virus serotype).

In another aspect, the invention provides a fragment of a nucleic acid of the invention that comprises a unique sequence of nucleotides of at least about 300, preferably at least about 400, more preferably at least about 600, desirably at least about 900, and more desirably at least about 1200 nucleotides from a sequence selected from any of SEQ ID NOS:156-200 and 235, as compared to a wild-type dengue PRM15/tE-polypeptide encoding sequence selected from any of SEQ ID NOS:149-152 and similar known dengue virus PRM15/tE polypeptide-encoding nucleotide sequences, including those available in GenBank, and more preferably as compared to any known wild-type flaviviral PRM15/tE polypeptide-encoding nucleotide sequence. Such fragment induces an immune response in a subject to at least one dengue virus of at least one serotype and is useful in, among other things, methods of inducing an immune response in a subject or population of the subject's cells against at least one dengue virus of at least one serotype (e.g., neutralizing Ab response against one or more viruses of one or more dengue virus serotypes).

In another aspect, the invention provides a fragment of a nucleic acid of the invention that comprises a unique sequence of nucleotides of at least about 300, preferably at least about 400, more preferably at least about 600, desirably at least about 900, and more desirably at least about 1200 nucleotides from a sequence selected from any of SEQ ID NOS:201-210, 211-218, 254-271, 342, and 344, as compared to a non-codon optimized WT C15/full prM/full E-polypeptide encoding sequence selected from any of SEQ ID NOS: 227-230 and a known dengue virus C15/full prM/full E polypeptide-encoding nucleotide sequences, including those available in GenBank, and more preferably as compared to any known WT flaviviral C15/full prM/full E polypeptide-encoding nucleotide sequence. Such fragment induces an immune response in a subject or population of its cells to at least one dengue virus of at least one serotype and is useful in, among other things, methods of inducing an immune response in such subject or cells against at least one dengue virus of at least one serotype (e.g., neutralizing Ab response against one or more serotypes).

The invention also provides a nucleic acid that selectively hybridizes to at least one of SEQ ID NOS:285-330, or the complement thereof, than as compared to a wild-type dengue tE-polypeptide encoding sequence selected from any of SEQ ID NOS:338-341 and a known dengue virus truncated E polypeptide-encoding nucleotide sequences, including those in GenBank, and more preferably as compared to any known wild-type flaviviral truncated E polypeptide-encoding nucleotide sequence, or the complement thereof, as applicable.

The invention also provides a nucleic acid that selectively hybridizes to at least one of SEQ ID NOS:156-200, 211-214, and 235, or the complement thereof, as compared to a wild-type dengue PRM15/tE-polypeptide encoding sequence selected from any of SEQ ID NOS:149-152 and similar known dengue virus PRM15/tE polypeptide-encoding nucleotide sequences, including those available in GenBank, and more preferably as compared to any known wild-type flaviviral PRM15/tE polypeptide-encoding nucleotide sequence, or the complement thereof, as applicable.

The invention also provides a nucleic acid that selectively hybridizes to at least one of SEQ ID NOS:201-210, 215-218, 254-271, 342, and 344, or the complement thereof, as compared to a non-codon optimized wild-type dengue C15/full prM/full E-polypeptide encoding sequence selected from any of SEQ ID NOS:227-230 and a known dengue virus C15/full prM/full E polypeptide-encoding nucleotide sequences, including those available in GenBank, and more preferably as compared to any known wild-type flaviviral C15/full prM/full E polypeptide-encoding nucleotide sequence, as applicable.

The invention further provides a composition and/or a nucleic acid obtained by cleaving a nucleic acid of the invention. The nucleic acid can be cleaved by mechanical, chemical, or enzymatic cleavage. Techniques for cleavage of nucleic acids are known in the art. Cleavage by enzymatic cleavage, particularly endonuclease, exonuclease digestion, RNAse digestion, or DNAse (e.g., benzon nuclease, such as Benzonase®) digestion of the nucleic acid. The composition also can comprise the products of cleaving multiple nucleic acids of the invention by such techniques.

The invention further provides a composition and/or nucleic acid produced by a process that comprises incubating a nucleic acid of the invention in the presence of nucleotide triphosphates (NTPs, preferably dNTPs) and a nucleic acid polymerase. Typically, and preferably, the polymerase is a thermostable polymerase, such as a Taq polymerase.

In another aspect, the invention provides a library or pool of non-identical nucleic acids of the invention and/or a library of nucleic acids comprising at least one nucleic acid of the invention. For example, the invention provides a library of nucleic acids comprising at least one nucleic acid having substantial identity (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with at least one polynucleotide sequence selected from the group of SEQ ID NOS:156-218, 235, 254-271, 285-330, 342, and 344.

In another context, the invention provides a library of non-identical nucleic acids that have substantial identity (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) with at least one sequence selected from SEQ ID NOS:156-218, 235, 254-271, 285-330, 342, and 344,. For example, the library in either case might be a library obtained by the above-described recursive sequence recombination techniques.

Thus, for example, the invention provides a composition comprising a library of nucleic acids obtained by a method comprising recombining at least a first nucleic acid comprising a sequence selected from SEQ ID NOS:211-214 and/or 215-218, and at least a second nucleic acid, wherein the first and second nucleic acids differ from each other in two or more nucleotides, to produce a library of recombinant or synthetic nucleic acids. The invention also provides nucleic acids produced by similar recombination reactions using any nucleic acid of the invention.

The invention also provides a method of recombination comprising subjecting at least one nucleic acid sequence of the invention to recursive sequence recombination with at least one additional nucleic acid, as described above. Regardless of how the library or pool is produced, the library or pool can comprises any suitable number of nucleic acid species therein. For example, the library can comprise at least about 2, 5, 10, 50 or more non-identical nucleic acids of the invention. The library can be inserted into one or more cells, e.g., by library transfection techniques. Such a population of cells is also contemplated.

The invention also provides a composition comprising such a library. For example, a library of nucleic acids as described above can be used for diagnosis of gene expression (e.g., by way of "gene chip" technology well-known in the art). Such libraries can be subject to expression, hybridization, or any other form of analysis for any suitable diagnostic purpose.

The invention also provides a method of producing a modified nucleic acid comprising mutating a nucleic acid of the invention (e.g., a nucleic acid selected from the group of SEQ ID NOS:156-218, 235, 254-271, 285-330, 342, and 344,). The invention further provides a modified nucleic acid produced by this method. Methods for mutating nucleic acids of the invention are described elsewhere herein.

The polynucleotide of the invention can be in the form of an aptamer (as described in, e.g., Famulok and Mayer—http://www.chemie.uni-bonn.de/oc/ak_fa/publications/CTMI-paper.pdf), capable of binding to suitable targets. The nucleic acids of the invention also can be used to form triplex-forming inhibitory nucleotides. The nucleic acid also can be conjugated to a DNA binding domain, such that they silence gene expression of undesired genes (e.g., act as gene decoys).

The invention also provides protein mimetics of the polypeptides of the invention. Peptide mimetics are described in, e.g., U.S. Pat. No. 5,668,110 and the references cited therein. Furthermore, the fusion protein can be modified by the addition of protecting groups to the side chains of one or more the amino acids of the fusion protein. Such protecting groups can facilitate transport of the fusion peptide through membranes, if desired, or through certain tissues, for example, by reducing the hydrophilicity and increasing the lipophilicity of the peptide. Examples of suitable protecting groups include ester protecting groups, amine protecting groups, acyl protecting groups, and carboxylic acid protecting groups, which are known in the art (see, e.g., U.S. Pat. No. 6,121,236). Synthetic fusion proteins of the invention can take any suitable form. For example, the fusion protein can be structurally modified from its naturally occurring configuration to form a cyclic peptide or other structurally modified peptide. The polypeptide of the invention also can be linked to one or more nonproteinaceous polymers, typically a hydrophilic synthetic polymer, e.g., polyethylene glycol (PEG), polypropylene glycol, or polyoxyalkylene, as described in, e.g., U.S. Pat. Nos. 4,179,337, 4,301,144, 4,496,689, 4,640,835, 4,670,417, and 4,791,192, or a similar polymer such as polyvinylalcohol or polyvinylpyrrolidone (PVP). As discussed above, the polypeptide can be subject to common protein modifications, such as carboxylation, glycosylation, hydroxylation, lipid or lipid derivative-attachment, methylation, myristylation, phosphorylation, and sulfation. Other post-translational modifications include acetylation, acylation, ADP-ribosylation, amidation, covalent attachment of flavin, covalent attachment of a heme moiety, covalent attachment of a nucleotide or nucleotide derivative, covalent attachment of phosphotidylinositol, cross-linking, cyclization, disulfide bond formation, demethylation, formylation, GPI anchor formation, iodination, oxidation, proteolytic processing, prenylation, racemization, selenoylation, arginylation, and ubiquitination. Other common protein modifications are described in, e.g., Creighton, supra, Seifter et al. (1990) *Meth Enzymol* 18:626-646, and Rattan et al. (1992) *Ann NY Acad Sci* 663:48-62. Such modifications are usually the result of post-translational modifications that occur in recombinant polypeptides of the invention (alternatively, such modifications can be carried out synthetically). Post-translational modifications for polypeptides expressed from nucleic acids in host cells vary depending what kind of host or host cell type the peptide is expressed in. For instance, glycosylation often does not occur in bacterial hosts such as *E. coli* and varies considerably in baculovirus systems as compared to mammalian cell systems. Accordingly, when glycosylation is desired, a polypeptide should be expressed (produced) in a glycosylating host, generally a eukaryotic cell (e.g., a mammalian cell or an insect cell). Additional and particularly preferred protein modifications are discussed elsewhere herein. Modifications to the polypeptide can be verified by any suitable technique, including, e.g., x-ray diffraction, NMR imaging, mass spectrometry, and/or chromatography (e.g., reverse phase chromatography, affinity chromatography, or GLC).

The polypeptide also or alternatively can comprise any suitable number of non-naturally occurring amino acids (e.g., β amino acids) and/or alternative amino acids (e.g., selenocysteine), or amino acid analogs, such as those listed in the *Manual of Patent Examining Procedure* §2422 (7th Revision—2000), which can be incorporated by protein synthesis, such as through solid phase protein synthesis (as described in, e.g., Merrifield (1969) *Adv Enzymol* 32:221-296 and other references cited herein).

Recently, the production of fusion proteins comprising a prion-determining domain has been used to produce a protein vector capable of non-Mendelian transmission to progeny cells (see, e.g., Li et al., *J. Mol. Biol.*, 301(3), 567-73 (2000)). The inclusion of such prion-determining sequences in a fusion protein comprising immunogenic amino acid sequences of the invention is contemplated, ideally to provide a hereditable protein vector comprising the fusion protein that does not require a change in the host's genome.

The invention also provides a polypeptide which comprises an amino acid sequence of at least about 45 amino acids in length, preferably at least about 55 amino acids in length, and more preferably at least about 80 amino acids in length, corresponding to a fragment of a polypeptide of any one of SEQ ID NOS:139-148, 236-253, 343, and 345, wherein the amino acid sequence is unique as compared to a polypeptide encoded by any of SEQ ID NOS:215-217, and known dengue virus C15/full prM/full E polypeptides. In addition, the invention provides a polypeptide which comprises an amino acid sequence of at least about 45 amino acids in length, preferably at least about 55 amino acids in length, and more preferably at least about 80 amino acids in length, corresponding to a fragment of a polypeptide of any one of SEQ ID NOS:156-200 and 235, wherein the amino acid sequence is unique as compared to a polypeptide encoded by any of SEQ ID NOS: 211-214, and known dengue virus PRM15/tE polypeptides.

In another aspect, the invention provides a polypeptide which is specifically bound by polyclonal antisera raised against at least one antigen, the at least one antigen comprising an amino acid sequence selected from the group of SEQ ID NOS:1-49 and 153-155, or an antigenic or immunogenic fragment thereof, wherein said antigenic or immunogenic polypeptide fragment induces an immune response in a subject against at least one dengue virus of at least one virus serotype that is about equal to or greater than the immune response induced in the mammalian cell by a antigenic or immunogenic polypeptide fragment of the at least one dengue virus of the at least one serotype; wherein the polyclonal antisera is subtracted with at least one of (1) a truncated envelope protein selected from the group of SEQ ID NOS: 338-341 and (2) a truncated envelope protein comprising an amino acid sequence fragment of a known dengue virus truncated E polypeptide, wherein said amino acid sequence fragment has a length substantially identical (e.g., having at least about 75%, 80%, 85%, 86%, 87%, 88%, 89%, 90%, 91%, 92%, 93%, 94%, 95%, 96% 97%, 98%, 99%, 99.5% sequence identity) to the truncated E protein of any of SEQ ID NOS:338-341.

The invention also includes an antibody or antisera that specifically binds a polypeptide, the polypeptide comprising an amino acid sequence selected from the group of SEQ ID NOS:1-49 and 153-155, wherein the antibody or antisera does not specifically bind to a polypeptide comprising one or more of: the polypeptides of SEQ ID NOS:338-341 and known dengue virus truncated E proteins.

Further provided is a recombinant or synthetic polypeptide which is specifically bound by a polyclonal antisera raised against at least one antigen, the antigen comprising an amino acid sequence selected from the group of SEQ ID NOS:65-116, or a fragment thereof, wherein the antisera is subtracted with polypeptides encoded by SEQ ID NOS:149-152, and known dengue virus PRM15/tE polypeptides.

Further provided is a recombinant or synthetic polypeptide which is specifically bound by a polyclonal antisera raised against at least one antigen, the antigen comprising an amino acid sequence selected from the group of SEQ ID NOS:139-148, 236-253, 343, and 345, or a fragment thereof, wherein the antisera is subtracted with polypeptides encoded by SEQ ID NOS:227-230, and known dengue virus C15/full prM/full E polypeptides.

In general, the polypeptides of the invention provide structural features that can be recognized, e.g., in immunological assays. The production of antisera comprising at least one antibody (for at least one antigen) that specifically binds a polypeptide of the invention, and the polypeptides which are bound by such antisera, are features of the invention. Binding agents, including antibodies described herein, may bind the dengue antigen polypeptides of the invention and/or fragments thereof with affinities of about $1\times10^2$ $M^{-1}$ to about $1\times10^{10}$ $M^{-1}$ (i.e., about $10^{-2}$-$10^{-10}$ M) or greater, including about $10^4$ to $10^6$ $M^{-1}$, about $10^6$ to $10^7$ $M^{-1}$, or about $10^8$ $M^{-1}$ to $10^9$ $M^{-1}$ or $10^{10}$ $M^{-1}$. Conventional hybridoma technology can be used to produce antibodies having affinities of up to about $10^9$ $M^{-1}$. However, new technologies, including phage display and transgenic mice, can be used to achieve higher affinities (e.g., up to at least about $10^{12}$ $M^{-1}$). In general, a higher binding affinity is advantageous.

In order to produce antiserum or antisera for use in an immunoassay, at least one immunogenic polypeptide (or polypeptide-encoding polynucleotide) of the invention is produced and purified as described herein. For example, recombinant polypeptide may be produced in a mammalian cell line. Alternatively, an inbred strain of mice can immunized with the immunogenic protein(s) in combination with a standard adjuvant, such as Freund's adjuvant or alum, and a standard mouse immunization protocol (see Harlow and Lane, supra, for a standard description of antibody generation, immunoassay formats and conditions that can be used to determine specific immunoreactivity). Alternatively, at least one synthetic or recombinant polypeptide derived from at least one polypeptide sequence disclosed herein or expressed from at least one polynucleotide sequence disclosed herein can be conjugated to a carrier protein and used as an immunogen for the production of antiserum. Polyclonal antisera typically are collected and titered against the immunogenic polypeptide in an immunoassay, for example, a solid phase immunoassay with one or more of the immunogenic proteins immobilized on a solid support. In the above-described methods where novel antibodies and antisera are provided, antisera resulting from the administration of the polypeptide (or polynucleotide and/or vector) with a titer of about $10^6$ or more typically are selected, pooled and subtracted with the control co-stimulatory polypeptides to produce subtracted pooled titered polyclonal antisera.

Cross-reactivity of antibodies can be determined using standard techniques, such as competitive binding immunoassays and/or parallel binding assays, and standard calculations for determining the percent cross-reactivity. Usually, where the percent cross-reactivity is at least 5-10× as high for the test polypeptides, the test polypeptides are said to specifically bind the pooled subtracted antisera or antibody.

Antisera raised or induced by an immunizing antigen may bind related antigens (e.g., cross-react). In such instance, the cross-reacting antigens comprise the same or substantially equivalent epitopes or comprise epitopes that are, e.g., sufficiently similar in shape to bind the same antibody.

The invention also provides polynucleotide consensus sequences derived from a comparison of two or more of the polynucleotide sequences described herein (e.g., a consensus sequence obtained by comparison of two or more sequences selected from, e.g., SEQ ID NOS:156-218, 235, 254-271, 285-330, 342, and 344). Preferably, the nucleic acid provides a non-naturally-occurring or recombinant polynucleotide comprising a sequence obtained by selection of nucleic acids from such a consensus sequence. The invention also provides a polypeptide consensus sequence obtained by similar analysis of at least two polypeptides of the invention (e.g., by comparison of any two amino acids selected from the group of SEQ ID NOS:1-49, 65-116, 139-148, 153-155, 236-253, 343, and 345). The invention further provides a polypeptide comprising a sequence according to the sequence pattern (formula) obtained by such consensus sequence analysis. Examples of such formulas are described herein, such as the one obtained by standard alignment of the polypeptides.

The invention also provides polypeptides and/or polynucleotides that comprise a sequence that has substantial local sequence identity, in contrast to global/overall sequence identity (discussed primarily herein), to one of the sequences specifically disclosed herein. Local sequence identity can be determined using local sequence alignment software, e.g., the BLAST programs described above, the LFASTA program, or, more preferably, the LALIGN program. Preferably, the LALIGN program using a BLOSUM50 matrix analysis is used for amino acid sequence analysis, and a +5 match/−4 mismatch analysis is used for polynucleotide sequence analysis. Gap extension and opening penalties are preferably the same as those described above with respect to analysis with the ALIGN program. For LALIGN (or other program) analysis using k-tup value settings (also referred to as "k-tuple" or ktup values), a k-tup value of 0-3 for proteins, and 0-10 (e.g., about 6) for nucleotide sequences, is preferred. The invention provides in this respect, for example, a polynucleotide that comprises a sequence that has substantial local identity (i.e., a percent identity similar to the percent identities discussed with respect to substantially identical sequences) (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% sequence identity) over a sequence of at least about 300, desirably at least about 450, more desirably at least about 600, preferably at least about 900, and more preferably at least about 1200 nucleotides, with an immunogenic amino acid-encoding portion of a nucleic acid of the invention, despite lacking substantial identity due to gap penalties and/or differences in length of the analyzed sequences. Similarly, the invention provides a polypeptide that comprises an amino acid sequence of at least about 10, preferably at least about 20, more preferably at least about 50, favorably at least about 100, more favorably at least about 200, or more (e.g., at least about 300, 350, or 375) amino acid residues that has substantial local identity with an immunogenic amino acid sequence of one of the recombinant polypeptides of the invention (e.g., a recombinant tE sequence, full E sequence, PRM15/tE sequence, C15/full prM/tE sequence, C15/full prM/full E sequence, etc.).

A recombinant polypeptide of the invention desirably, though not necessarily, exhibits primary, secondary, and/or tertiary structural similarity to a wild-type dengue virus polypeptide, or at least a fragment thereof of similar length to the recombinant polypeptide. For example, a recombinant tE, full E, PRM15/tE, C15/full prM/tE, or C15/full prM/full E polypeptide may exhibit primary, secondary, and/or tertiary structural similarity to a wild-type dengue virus polypeptide tE, full E, PRM15/tE, C15/full prM/tE, or C15/full prM/full E polypeptide, respectively. Structural similarity can be determined by any suitable technique, preferably using a suitable software program for making such assessments. Examples of such programs include the MAPS program and the TOP program (described in Lu, *Protein Data Bank Quarterly Newsletter*, #78, 10-11 (1996), and Lu, *J. Appl. Cryst.*, 33, 176-183 (2000)). The polypeptide and/or prM/E protein desirably exhibit topological diversity in such contexts (e.g., a topical diversity of less than about 20, preferably less than about 15, and more preferably less than about 10), or both. However, polypeptides having high structural diversity can be suitable and even preferred. Such diverse, but functional, peptides can be obtained by recursive sequence recombination techniques described above. Alternatively, the structure of proteins can be compared using the PROCHECK program (described in, e.g., Laskowski, *J. Appl. Cryst.*, 26, 283-291 (1993)), the MODELLER program, or commercially available programs incorporating such features. Alternatively still, structure predictions can be compared by way of a sequence comparison using a program such as the PredictProtein server (available at http://dodo.cpmc.columbia.edu/predictprotein/). Additional techniques for analyzing protein structure that can be applied to determine structural similarity are described in, e.g., Yang and Honig, *J. Mol. Biol.*, 301(3), 665-78 (2000), Aronson et al., *Protein Sci.*, 3(10), 1706-11 (1994), Marti-Remon et al., *Annu. Rev. Biophys. Biomol. Struct.*, 29, 291-325 (2000), Halaby et al., *Protein Eng.*, 12(7), 563-71 (1999), Basham, *Science*, 283, 1132 (1999), Johnston et al., *Crit. Rev. Biochem. Mol. Biol.*, 29(J), 1-68 (1994), Moult, *Curr. Opin. Biotechnol.*, 10(6), 583-6 (1999), Benner et al., *Science*, 274, 1448-49 (1996), and Benner et al., *Science*, 273, 426-8 (1996), as well as Int'l Patent Application WO 00/45334.

Kits of the invention optionally comprise at least one of the following of the invention: (1) an apparatus, system, system component, or apparatus component as described herein; (2) at least one kit component comprising at least one polypeptide, polynucleotide (or fragment of either thereof), vector, antibody, and/or cell of the invention; one or more cells comprising at least one polypeptide, polynucleotide, vector, and/ or antibody of the invention; a cell expressing a polypeptide of the invention; a composition, pharmaceutical composition, or vaccine composition (composition suitable for use as a vaccine in mammals) comprising at least one of any component above (e.g., polypeptide, polynucleotide, vector, antibody, and/or cell of the invention) or any combination thereof; (3) instructions for practicing any method described herein, including methods of inducing immune response, methods of immunizing, methods of detecting or diagnosing the presence or one or more antibodies to at least one dengue virus of one or more serotypes in a biological sample, therapeutic or prophylactic methods, instructions for using any component identified in (2) or any vaccine or composition of any such component; and/or instructions for operating any apparatus, system or component described herein; (4) a container for holding said at least one such component or composition, and (5) packaging materials. In a further aspect, the present invention provides for the use of any apparatus, component, composition, or kit described above and herein, for the practice of any method or assay described herein, and/or for the use of any apparatus, component, composition, or kit to practice any assay or method described herein.

The invention provides computers, computer readable media, and integrated systems comprising character strings corresponding to the sequence information herein for the polypeptides and nucleic acids herein, including, e.g., those sequences listed herein and various silent substitutions and conservative substitutions thereof. Various methods and genetic algorithms (GAs) known in the art can be used to detect homology or similarity between different character strings, or can be used to perform other desirable functions such as to control output files, provide the basis for making presentations of information including the sequences and the like. Examples include BLAST, discussed supra.

Different types of homology and similarity of various stringency and length can be detected and recognized in the integrated systems herein. E.g., many homology determination methods have been designed for comparative analysis of sequences of biopolymers, for spell-checking in word processing, and for data retrieval from various databases. With an understanding of double-helix pair-wise complement interactions among 4 principal nucleobases in natural polynucleotides, models that simulate annealing of complementary homologous polynucleotide strings can also be used as a foundation of sequence alignment or other operations typically performed on the character strings corresponding to the sequences herein (e.g., word-processing manipulations, construction of figures comprising sequence or subsequence character strings, output tables, etc.). An example of a software package with GAs for calculating sequence similarity is BLAST, which can be adapted to the invention by inputting character strings corresponding to the sequences herein.

Similarly, standard desktop applications such as word processing software (e.g., Microsoft Word™ or Corel WordPerfect™) and database software (e.g., spreadsheet software such as Microsoft Excel™, Corel Quattro Pro™, or database programs such as Microsoft Access™ or Paradox™) can be adapted to the present invention by inputting a character string corresponding to the polypeptides or polynucleotides of the invention or both, or fragments of either. For example, the integrated systems can include the foregoing software having the appropriate character string information, e.g., used in conjunction with a user interface (e.g., a GUI in a standard operating system such as a Windows, Macintosh or LINUX system) to manipulate strings of characters. As noted, specialized alignment programs such as BLAST can also be incorporated into the systems of the invention for alignment of nucleic acids or proteins (or corresponding character strings).

Integrated systems for analysis in the present invention typically include a digital computer with GA software for aligning sequences, as well as data sets entered into the software system comprising any of the sequences described herein. The computer can be, e.g., a PC (Intel x86 or Pentium chip-compatible DOS™, OS2™ WINDOWS™ WINDOWS NT™, WINDOWS95™, WINDOWS98™ LINUX based machine, a MACINTOSH™, Power PC, or a UNIX based (e.g., SUN™ work station) machine) or other commercially common computer which is known to one of skill. Software for aligning or otherwise manipulating sequences is available, or can easily be constructed by one of skill using a standard programming language such as Visualbasic, Fortran, Basic, Java, or the like.

Any controller or computer optionally includes a monitor which is often a cathode ray tube ("CRT") display, a flat panel display (e.g., active matrix liquid crystal display, liquid crystal display), or others. Computer circuitry is often placed in a box which includes numerous integrated circuit chips, such as a microprocessor, memory, interface circuits, and others. The box also optionally includes a hard disk drive, a floppy disk drive, a high capacity removable drive such as a writeable CD-ROM, and other common peripheral elements. Inputting devices such as a keyboard or mouse optionally provide for input from a user and for user selection of sequences to be compared or otherwise manipulated in the relevant computer system.

The computer may include appropriate software for receiving user instructions, either in the form of user input into a set parameter fields, e.g., in a GUI, or in the form of preprogrammed instructions, e.g., preprogrammed for a variety of different specific operations. The software then converts these instructions to appropriate language for instructing the operation of the fluid direction and transport controller to carry out the desired operation. The software can also include output elements for controlling nucleic acid synthesis (e.g., based upon a sequence or an alignment of a sequence herein) or other operations which occur downstream from an alignment or other operation performed using a character string corresponding to a sequence herein.

In a particular aspect of such an embodiment of the invention, the invention provides a computer or computer readable medium comprising a database comprising a sequence record comprising one or more character string corresponding to a nucleic acid sequence selected from the group of SEQ ID NOS:156-218, 235, 254-271, 285-330, 342, and 344, or a polypeptide sequence selected from the group of SEQ ID NOS:1-49, 65-116, 139-148, 153-155, 236-253, 343, and 345.

The invention provides an integrated system comprising a computer or computer readable medium comprising a database comprising at least one sequence record, each comprising at least one character string corresponding to a nucleic acid or protein sequence selected from any of SEQ ID NOS: 1-49, 65-116, 139-148, 153-218, 235-253, 254-271, 285-330, 342-345, the integrated system further comprising a user input interface allowing a user to selectively view one or more sequence records. For some such integrated systems, the computer or computer readable medium comprising an alignment instruction set which aligns the character strings with at least one additional character string corresponding to a nucleic acid or protein sequence. The instruction set may comprise one or more of: a local homology comparison determination, a homology alignment determination, a search for similarity determination, and a BLAST determination. Some such systems may also comprise a user readable output element that displays an alignment produced by the alignment instruction set.

In some aspects, the computer or computer readable medium further comprises an instruction set which translates at least one nucleic acid sequence comprising a sequence selected from the group of SEQ ID NOS:156-218, 235, 254-271, 285-330, 342, and 344 into an amino acid sequence. In other aspects, the computer or computer readable medium further comprising an instruction set for reverse-translating at least one amino acid sequence comprising a sequence selected from SEQ ID NOS:1-49, 65-116, 139-148, 153-155, 236-253, 343, and 345 into a nucleic acid sequence. For some such systems, the instruction set selects the nucleic acid sequence by applying a codon usage instruction set or an instruction set which determines sequence identity to a test nucleic acid sequence.

Also provided is a method of using a computer system to present information pertaining to at least one of a plurality of sequence records stored in a database, each of said sequence records each comprising at least one character string corresponding to one or more of SEQ ID NOS:1-49, 65-116, 139-148, 153-218, 235-253, 254-271, 285-330, 342-345, the method comprising: determining a list of one or more character strings corresponding to one or more of said above-referenced SEQ ID NOS, or a subsequence thereof; determining which one or more character strings of said list are selected by a user; and displaying the selected character strings, or aligning the selected character strings with an additional character string. Some such methods further comprise displaying an alignment of the selected character string with the additional character string and/or displaying the list.

In a further aspect, the invention provides a method of generating and/or selecting a polypeptide variant comprising using a character string corresponding to at least one of SEQ ID NOS: 1-49, 65-116, 139-148, 153-155, 236-253, 343, and 345, preferably in combination with additional biological functional information (e.g., neutralizing antibody titer against one or more dengue virus serotypes) to an algorithm, preferably facilitated by a computer media, the analyzed outcome of which generates one or more amino acid sequences, pattern of sequence characteristics, sequence changes (mutations), and/or structures that are suggestive of a polypeptide that exhibits a similar and/or improved biological property of such polypeptides. The method can include subjecting the character strings to any suitable type of genetic modeling or algorithm known in the art, including, e.g., statistical analysis techniques such as Markov modeling, principal component analysis, neural network analysis, random recombination-modeling approaches, and physical recombination approaches. Examples of such techniques are described in, e.g., International Patent Applications WO 01/83559, WO 99/49893, and WO 01/61344, and U.S. Pat. No. 6,269,312. Additional techniques and principles are described in, e.g., International Patent Applications WO 00/42561, WO 01/51663, and WO 01/90197 as well as Norton et al. Virus Res 55(1):37-48 (1998), Rappuoli, *Curr Opin Microbiol* 3(5): 445-450 (2000), Petersen et al., *Scand J. Immunol* 53(4):357-364 (2001), and Nakai *J. Struct Biol* 134(2-3):103-116 (2001). Amino acid and nucleotide sequences produced having a non-wild-type sequence generated by such in silico modeling using a character string corresponding to SEQ ID NOS:1-49, 65-116, 139-148, 153-218, 235-253, 254-271, 285-330, 342-345 are a feature of the invention.

Any of the above described features of the polypeptides, polynucleotides, vectors, cells, compositions, and methods of the invention can be combined in any suitable manner, unless otherwise stated or clearly contradicted by context.

Any molecule of the invention, including any nucleic acid, polypeptide, protein, peptide, or fusion protein of the invention, or any vector, cell, or composition comprising any such molecule as described herein, can be used in any of the methods and applications of the invention described herein. In one aspect, the invention provides for the use of any such molecule, including any nucleic acid, polypeptide, protein, peptide, or fusion protein, or any vector, cell, or composition comprising any such molecule as described herein, as a medicament, drug, therapeutic or prophylactic agent, or vaccine, for the treatment or prevention of a disease or disorder, including those diseases and disorders described herein (e.g., those related to dengue virus infection), or the like. In another aspect, the invention provides for the use of any such molecule (e.g., any nucleic acid, polypeptide, protein, fusion protein, or peptide of the invention) or any vector, cell, or composition comprising any such molecule, for the manufacture of a medicament, prophylactic or therapeutic agent, drug, or vaccine, for use in any applicable therapeutic or prophylactic method for the treatment or prevention of a disease or disorder, including those described herein (e.g., those related to dengue virus infection).

EXAMPLES

The following examples further illustrate the invention, but should not be construed as in any way limiting its scope in any way.

Example 1

This example illustrates the generation and identification of novel nucleic acids that encode recombinant, synthetic or mutant dengue virus antigens, polypeptides comprising such dengue virus antigens, the construction of an exemplary DNA vectors for delivery of such nucleic acids to mammalian cells, and the expression of such nucleic acids by transfection of mammalian cells with such a vector, resulting in high levels of expression and secretion of the encoded dengue antigens.

A. Synthesis of Novel Dengue Antigen-Encoding Nucleotide Sequences

The amino acid sequences of the various proteins of each of the four WT DEN-1, DEN-2, DEN-3, and DEN-4 viruses were analyzed to identify the following regions of the polyprotein of each of the four WT dengue virus serotypes: (1) the amino acid segment or fragment of the dengue polyprotein sequence corresponding to the C-terminal 15 amino acids of the prM protein ("PRM15"), which 15 amino acid segment of the prM protein may serve as a signal sequence for the dengue envelope (E) protein; (2) the amino acids comprising most of the full length E protein sequence of the dengue polyprotein sequence, i.e., excluding those amino acid residues corresponding to approximately 5% to about 12% of the C-terminal region of the E protein sequence that encode a portion of the hydrophobic region). Thus, an amino acid sequence was identified from the polyprotein sequence of each of the four WT dengue virus serotypes; each such amino acid sequence comprised a fusion protein comprising the C-terminal 15 amino acid residues of the prM protein (e.g., 15 amino acid residues of the M protein) and approximately 90-95% of the N-terminal amino acid residues of the E protein (hence, a termed a "truncated" E protein). See FIG. 14. These amino acid sequences identified from each of the wild-type DEN-1, DEN-2, DEN-3, and DEN-4 polyproteins were termed Den-1PRM15/trunc E (or Den-1PRM15/tE) (SEQ ID NO:149), Den-2PRM15/trunc E (or Den-2PRM15/tE) (SEQ ID NO:150), Den-3PRM15/trunc E (or Den-3PRM15/tE) (SEQ ID NO:151), and Den-4PRM15/trunc E (or Den-4PRM15/tE) (SEQ ID NO:152) dengue antigen fusion proteins, respectively. Collectively, these sequences may be termed the "truncated" parental polypeptides. These fusion proteins can be made by expression from plasmid vectors, such as E. coli vectors, viral vectors, baculovirus vectors, or other plasmid vectors, and produced in insect cells, E. coli cells, or mammalian cell cultures by standard techniques known in the art and described herein. Alternatively, proteins can be assembled from protein fragments or peptide fragments made by standard protein synthesis techniques well known in the art and discussed above.

Each of these four identified amino acid sequences was back translated to a nucleotide sequence, using a standard human codon frequency table (http://www.kazusa.orp/codon/cgi-bin/showcodon.cgi?species=Homo+sapiens+[gb-pri]), to obtain a human codon optimized DNA sequence.

DNA oligonucleotides comprising overlapping portions of each identified human codon optimized PRM15 and truncated E fusion protein-encoding sequence were synthesized using standard techniques for each of the 4 dengue virus serotypes. For each of the virus serotypes, the overlapping oligos that collectively made up the PRM15/E truncated protein-encoding sequence were permitted to hybridize. DNA sequences corresponding to the codon optimized sequences were produced by standard PCR gene synthesis using the hybridized oligos as templates. For each of the PCR gene synthesis reactions, a 5' forward primer comprising nucleotide sequences overlapping the PRM15 sequence, an additional BamHI site and a 5'-ACC-3' Kozak consensus sequence (*Cell* 15:1109-23 (1978)) and a 3' reverse primer comprising nucleotide sequences overlapping the truncated E gene and a EcoRI restriction site were used, such that these sites and the consensus sequence were added to the resulting PRM15/truncated E-encoding PCR products. The resulting human codon optimized PRM15/truncated E-encoding DNA sequences were designated Den-1PRM15/truncE CO (or Den-1PRM15/tE CO) (SEQ ID NO:211), Den-2PRM15/truncE CO (or Den-2PRM15/tE CO) (SEQ ID NO:212), Den-3PRM15/truncE CO (or Den-3PRM15/tE CO (SEQ ID NO:213), and Den-4PRM15/truncE CO (or Den-4PRM15/tE CO) (SEQ ID NO:214), respectively, where "PRM15" refers to a signal nucleotide sequence comprising a sequence encoding the 15 amino acids of the C terminus of prM (i.e., PRM15) and typically an additional methionine residue (which is the first amino acid residue before the 15 amino acid sequence), "trunc" E or "tE" refers to the nucleotide sequence encoding a truncated E protein, and "CO" refers to codon optimized. Collectively, these nucleotide sequences may be termed the truncated parental nucleotide sequences, since they were used as parental nucleic acids in the recursive sequence recombination methods described herein.

Similar procedures are used to identify and make a polypeptide sequence comprising: the 15 amino acid residues of the capsid (C) protein of a particular WT dengue virus serotype polyprotein (e.g., Den-1, Den-2, Den-3, or Den-4), the amino acid sequence corresponding to the full length prM protein of said WT dengue virus polyprotein, and the amino acid sequence corresponding to said full length E protein of the WT dengue virus polyprotein. Such procedures are conducted using each of the four WT dengue virus polyproteins, and the resulting polypeptide sequences are termed Den-1 C15/full prM/full E (or Den-1 C15/prM/E) (SEQ ID NO:227), Den-2 C15/full prM/full E (or Den-2 C15/prM/E) (SEQ ID NO:228), Den-3 C15/full prM/full E (or Den-3 C15/prM/E) (SEQ ID NO:229), Den-4 C15/full prM/full E (or Den-4 C15/prM/E) (SEQ ID NO:230) dengue antigen fusion proteins, respectively.

Human codon optimized sequences that encode each of these dengue antigen fusion proteins are determined and made as described above, and the resulting nucleotide sequences are termed: Den-I $C_{15}$/full prM/full E CO (or Den-1 C15/prM/E CO) (SEQ ID NO:231), Den-2 C15/full prM/full E CO (or Den-2 C15/prM/E CO) (SEQ ID NO:232), Den-3 C15/full prM/full E CO (or Den-3 C15/prM/E CO) (SEQ ID NO:233), and Den-4 C15/full prM/full E CO (or Den-4 C15/prM/E CO) (SEQ ID NO:234) dengue antigen nucleotide sequences, respectively.

B. Construction of pMaxVax10.1

An exemplary mammalian expression vector termed "pMaxVax10.1" (see FIG. 1) comprises, among other things: (1) a promoter for driving the expression of a transgene (or other nucleotide sequence) in a mammalian cell (including, e.g., but not limited to, a CMV promoter or a variant thereof, and shuffled, synthetic, or recombinant promoters, including those described in PCT application having International Publication No. WO 02/00897; (2) a polylinker for cloning of one or more transgenes (or other nucleotide sequence); (3) a polyadenylation signal (e.g., polyA sequence); and (4) a prokaryotic replication origin and antibiotic resistant gene for amplification in E. coli. The construction of the vector is briefly described herein, although several suitable alternative techniques are available to produce such a DNA vector (e.g., applying the principles described elsewhere herein).

In one embodiment, the minimal plasmid Col/Kana comprises the replication origin ColE1 and the kanamycin resistance gene (Kana$^r$). The ColE1 origin of replication (ori) mediates high copy number plasmid amplification.

In one embodiment, the ColE1 ori was isolated from vector pUC19 (New England Biolabs, Inc.) by application of standard PCR techniques. To link the ColE1 origin to the Kana$^r$ gene, NgoMIV (or "NgoMI") and DraIII recognition sequences were added to the 5' and 3' PCR primers, respectively. NgoMIV and DraIII are unique cloning sites in pMaxVax10.1. For subsequent cloning of the mammalian transcription unit, the 5' forward primer also was designed to include the additional restriction site NheI downstream of the NgoMIV site and EcoRV and BsrGI cloning sites upstream of the DraIII site the 3' reverse primer. All of the primers were designed to include additional 6-8 base pairs overhang for optimal restriction digest. Specifically, the sequence for the 5' forward primer ("pMaxVax primer 1") is acacatagcgccg-gcgctagctgagcaaaaggccagcaaaaggcca (SEQ ID NO:331) and the sequence for the 3' reverse primer ("pMaxVax primer 2") aactctgtgagacaacagtcataaatg-tacagatatcagaccaagtttactcatatatac (SEQ ID NO:332).

Typically, the ColE1 PCR reactions were performed with proof-reading polymerases, such as Tth (PE Applied Biosystems), Pfu, PfuTurbo and Herculase (Stratagene), or Pwo (Roche), under conditions in accordance with the manufacturer's recommendations. By way of illustration, a typical Herculase polymerase PCR reaction contains 1 µl template plasmid DNA (1-10 ng/µl), 5 µl 10× buffer, 1 µl dNTPs (deoxynucleotide triphosphates) at 10 mM each, 1 µl forward primer (20 µM), 1 µl reverse primer (20 µM), 40 µl deionized, sterile water and 0.5 µl Herculase polymerase in a 50 µL reaction. Such PCR reactions were performed at 94° C. for 30 seconds, 55° C. for 30 seconds, and 72° C. for 30 seconds per cycle, for a total of 25 cycles.

The ColE1 PCR product was purified with phenol/chloroform using Phase lock Gel™Tube (Eppendorf) followed by standard ethanol precipitation. The purified ColE1 PCR product was digested with the restriction enzymes NgoMIV and DraIII according to the manufacturer's recommendations (New England Biolabs, Inc.) and gel purified using the QiaExII gel extraction kit (Qiagen) according to the manufacturer's instructions.

In this embodiment, the Kanamycin resistance gene (transposon Tn903) was isolated from plasmid pACYC177 (New England Biolabs, Inc.) using standard PCR techniques. Specifically, a 5' PCR primer ("pMaxVax primer 3"), ggcttctca-cagagtggcgcgccgtgtctcaaaatctct (SEQ ID NO:333), comprising sequences homologous to the 5' kanamycin gene and an additional DraIII site upstream of an AscI site, and a 3' primer ("pMaxVax primer 4"), ttgctcagctagcgccggcgccgtc-ccgtcaagtcagcgt (SEQ ID NO:334), comprising sequences homologous to the 3' kanamycin gene and a NgoMIV cloning site, were used to amplify the Kana$^r$ gene from pACYC177. The PCR reactions, product purification and digest with DraIII and NgoMIV were performed as described above. About 20 ng of each of the Kanar PCR product and ColE1 PCR product were obtained and ligated in a 20 µl reaction, containing 2 µl 10× buffer and 1U ligase (Roche). Amplification in E. coli was performed using standard procedures as described in Sambrook, supra. Plasmids were purified with the QiaPrep-spin Miniprep kit (Qiagen) following the manufacturer's instructions and digested with BsrG1 and DraIII for subsequent ligation of the mammalian transcription unit (promoter and polyA).

In one embodiment, the pMaxVax10.1 vector comprise a CMV immediate early enhancer promoter (CMV IE), which was isolated from DNA of the CMV virus, Towne strain, by standard PCR methods. The cloning sites EcoRI and BamHI were incorporated into the PCR forward and reverse primers. The EcoRI and BamHI digested CMV IE PCR fragment was cloned into pUC19 for amplification. The CMV promoter was isolated from the amplified pUC19 plasmid by restriction digest with BamHI and BsrGI. The BsrGI site is located 168 bp downstream of the 5' end of the CMV promoter, resulting in a 1596 bp fragment, which was isolated by standard gel purification techniques for subsequent ligation.

In one embodiment, a polyadenylation signal from the bovine growth hormone (BGH) gene was used. Other polyadenylation signals (e.g., SV40 poly A sequences) may also be employed. In this instance, a BGH nucleotide sequence was isolated from the pcDNA3.1 vector (Invitrogen) by standard PCR techniques. Briefly, a 5' PCR forward primer ("pMaxVax primer 5"), agatctgtttaaaccgctgatcagcctc-gactgtgccttc (SEQ ID NO:335), which includes recognition sites for the restriction enzymes PmeI and BglII to form part of the p.MaxVax10.1 vector polylinker, and a 3' reverse primer ("pMaxVax primer 6"), acctctaaccactctgtgagaagc-catagagcccaccgca (SEQ ID NO:336), which includes a DraIII site for cloning to the minimal plasmid Col/Kana, were prepared by standard techniques and used to amplify a BGH polyA PCR product. The BGH polyA PCR product was diluted 1:100. 1 µl of the diluted BGH polyA PCR product was used as a template for a second PCR amplification using the same 3' reverse primer and a second 5' primer ("pMaxVax primer 7"), ggatccggtacctctagagaattcggcg-gccgcagatctgtttaaaccgctga (SEQ ID NO:337), which overlapped the 5' end of the template by 20 bp, and contained another 40 bp 5' sequence comprising BamHI, KpnI, XbaI, EcoRI, and NotI restriction sites for inclusion of these sites in the p.MaxVax10.1 vector polylinker.

The final ligation reaction to form pMaxVax10.1 was performed with about 20 ng each of the BsrG1 and BamHI digested CMV IE PCR product, BamHI and DraIII digested polylinker and BGH poly A PCR product, and the DraIII and BsrG1 digested minimal plasmid Col/Kana in a 50 µl reaction with 5 µl 10× ligase buffer and 2U ligase (Roche). Ligation, amplification and plasmid purification were performed as described above. The plasmid was transfected into E. coli using standard techniques for cloning.

C. Construction of pMaxVax10.1 Dengue Virus Antigen Expression Vector

In one aspect, BamHI and EcoRI digested and gel-purified Den-1PRM15/tE CO, Den-2PRM15/tE CO, Den-3PRM15/tE CO, and Den-4PRM15/tE CO nucleic acids (described above) were each cloned into the pMaxVax10.1 vector by digesting the vector with BamHI and EcoRI using standard techniques, gel purifying the linearized vector, and ligating the respective dengue antigen-encoding sequences (separately in 4 different ligation reactions to the vector to form 4 plasmid vector constructs, each comprising a codon optimized nucleic acid encoding Den-1PRM15/tE, Den-2PRM15/tE, Den-3PRM15/tE, or Den-4PRM15/tE fusion protein antigen (see FIG. 2). Such vectors are typically termed pMaxVax10.$1_{Den\text{-}1PRM15/tE\ CO}$, pMax Vax10.$1_{Den\text{-}2PRM15/tE\ CO}$, pMaxVax10.$1_{Den\text{-}3PRM15/tE\ CO}$, and pMaxVax10.$1_{Den\text{-}4PRM15/tE\ CO}$, respectively. FIG. 2 shows an exemplary pMaxVax10.1 expression vector comprising a nucleotide sequence corresponding to Den-2PRM15/tE CO. These dengue antigen fusion protein-encoding expression vectors were propagated in *E. coli* using standard techniques to obtain a population of plasmids for transfection experiments.

Similar procedures are used to construct pMaxVax10.1 expression vectors comprising each of the nucleotide sequences described above: Den-1 C15/full prM/full E CO (SEQ ID NO:231), Den-2 C15/full prM/full E CO (SEQ ID NO:232), Den-3 C15/full prM/full E CO (SEQ ID NO:233), and Den-4 C15/full prM/full E CO (SEQ ID NO:234).

D. Dengue Antigen Expression and Secretion Analysis for Den-1 PRM15/tE CO, Den-2PRM15/tE CO, Den-3PRM15/tE CO, and Den-4PRM15/tE CO Dengue antigens encoded by wild-type dengue nucleic acids (or portions or fragments thereof), are typically poorly expressed and secreted. To assess the expression and/or secretion of dengue antigens expressed from the above-described pMaxVax10.1 expression vectors the following techniques were performed.

Populations of human 293-HEK cells were grown in tissue culture under standard conditions, and each population was transfected with a pMaxVax10.1 expression vector comprising one of the nucleic acid sequences described above: Den-1PRM15/tE CO, Den-2PRM15/tE CO, Den-3PRM15/tE CO, or Den-4PRM15/tE CO. Transfections were carried out using commercially available transfections reagents, typically Effectene (Qiagen) and FuGene (Boehringer/Roche), in accordance with the manufacturer's instructions (e.g., with respect to amount of plasmid used for transfection). Each population of transfected 293 cells was incubated for about 48-72 hours under conditions permissive for transgene expression.

Two sets of samples of each of the transfected 293 cell cultures were prepared. The first set of samples was prepared by harvesting the supernatants of each population of cells transfected with one of the 4 expression plasmids and concentrating the volume 10-20 fold by standard methods (e.g., centrifugation using Ultrafree-4 centrifugal filter, Millipore, Mass.). The protein secretion levels were determined by Western blot analysis. In the other set of samples, cell of each population of cells transfected with one of the 4 expression plasmids were harvested, subjected to cell lysis, and the resulting lysate collected and subjected to Western blot analysis to determine expression levels.

For Western blot analysis, the proteins from the cell lysates and cell supernatants, respectively, were separated by polyacrylamide gel electrophoresis and blotted to nitrocellulose membranes using the technique described by the manufacturers (NuPage™ and Invitrogen, respectively). Cell lysates were run in one lane (marked "L") and cell supernatants were run in another lane (marked "SN") on a single polyacrylamide gel for each nucleic acid tested (e.g., p.Max Vax10.$1_{Den\text{-}2PRM15/tE\ Co}$ transfected cell lysates and supernatants were run on a single gel).

Polyclonal anti-DEN-1 mouse antisera and anti-DEN-3 mouse antisera were obtained from ATCC, polyclonal anti-DEN-4 mouse antisera were received from the WHO antibody collection, and a monoclonal anti-DEN-2 antibody was received from United States Biological (Swampscott Mass.—USA) (polyclonal anti-DEN-2 mouse antisera repeatedly failed to bind to denatured wild-type DEN-2 antigens on filters and, accordingly, were not used).

The filters were incubated with dengue virus serotype specific antibodies corresponding to the type of dengue antigen encoded by the nucleic acid used to transfect the samples (i.e., anti-DEN-2 mAb was used for filters blotted with the lysates or supernatant from pMaxVax10.$1_{Den\text{-}2PRM15/tE\ CO}$ transfected cells). The antibody-antigen incubations were performed for 1 hour at room temperature, the filters were washed 5 times for 25 minutes with PBS Buffer and 0.1% Tween 20, and the filters were further incubated with a secondary enzyme-conjugated (either a horse radish peroxidase (HRP)-conjugated or alkaline phosphatase-conjugated) anti-mouse antibody. After a 1-hour incubation at room temperature, the filters were washed and incubated with the enzyme substrates for colorimetric detection. The Western blot obtained by this experiment is shown in FIG. 3.

The Western blot shown in FIG. 3 demonstrates that antigens encoded by Den-1PRM15/tE CO, Den-2PRM15/tE CO, Den-3PRM15/tE CO, and Den-4PRM15/tE CO were well expressed in transfected 293 cells. However, only antigens expressed from pMaxVax10.1 vectors comprising Den-2PRM15/tE CO, Den-3PRM15/tE CO, and Den-4PRM15/tE CO appear to be secreted from transfected cells. In comparison, truncated envelope antigens expressed from wild-type dengue virus nucleotide sequences have been shown to be poorly expressed and very poorly secreted in mammalian cells.

These experiments demonstrate that nucleic acid sequences comprising Den-1PRM15/tE CO, Den-2PRM15/tE CO, Den-3PRM15/tE CO, and Den-4PRM15/tE CO sequences are capable of high levels of dengue antigen expression in transfected cells. Moreover, the results of these experiments demonstrate that select nucleic acid sequences of the invention can be used to effectively express dengue antigens as secreted proteins.

Similar methods are used to assess the expression and/or secretion of pMaxVax10.1 expression vectors comprising each of the following nucleotide sequences described above: Den-1 C15/full prM/full E CO (SEQ ID NO:231), Den-2 C15/full prM/full E CO (SEQ ID NO:232), Den-3 C15/full prM/full E CO (SEQ ID NO:233), and Den-4 C15/full prM/full E CO (SEQ ID NO:234).

Example 2

This example illustrates exemplary methods for generating libraries of nucleic acids encoding recombinant dengue antigens and screening or selecting from such libraries to identify recombinant nucleic acids that encode recombinant dengue antigens in mammalian cells.

Libraries of recombinant nucleic acid sequences were generated by recursive sequence recombination procedures using purified Den-1PRM15/tE CO, Den-2PRM15/tE CO, Den-3PRM15/tE CO, and Den-4PRM15/tE CO, e.g., as parental nucleotide sequences. The recursive sequence recombination procedures were conducted as described previously in, e.g., Stemmer (1994) *Nature* 370:389-391 and Crameri, A. et al. (1998) *Nature* 391:288-91, U.S. Pat. No. 5,837,458, and other references cited above in the section describing recursive sequence recombination, each incorporated herein by reference in its entirety for all purposes.

Briefly, each pMaxVax10.1 expression vector comprising a Den-1 PRM15/tE CO, Den-2 PRM15/tE CO, Den-3 PRM15/tE CO, or Den-4 PRM15/tE CO nucleotide sequence was cleaved by restriction enzymes flanking the dengue PRM15/tE nucleotide sequence, and each resulting nucleotide fragment were isolated by standard gel purification and subjected to recursive sequence recombination. The recombined nucleic acid products were then amplified by PCR with rescue primers located upstream of the 5' BamHI and 3' of the EcoRI cloning sites, digested with BamHI and EcoRI, and gel purified using standard techniques. The isolated recombinant nucleic acids were ligated into pMaxVax10.1 vectors (e.g., as described in Example 1 to form a recombinant library of recombinant DNA plasmid vectors, which were subsequently cloned in E. coli using standard library transfection techniques (see, e.g., Sambrook, supra) and according to manufacturer's instructions.

The transformed cells were plated overnight, the individual colonies were pooled, and plasmid DNA was prepared by standard purification methods (Qiagen). Plasmid DNA of the pMaxVax10.1 expression libraries was transfected into HEK-293 cells in culture using Superfect reagent (Qiagen) according to the manufacturer's instructions. Several libraries so produced were then analyzed for dengue antigen expression by flow cytometry (Fluorescence-Activated Cell Sorter—FACS analysis) with anti-dengue virus antibodies from mouse ascitic fluid.

Specifically, to perform FACS analysis, about $1\times10^5$ transfected 293 cells were incubated with a mixture of the mouse anti-dengue virus antibodies (as described above), dissolved in PBS buffer containing 2% fetal calf serum (FCS). The optimal antibody dilution was evaluated on a case-by-case basis for each antibody. In general, serial test dilutions of 1:500, 1:1000, and 1:2000 were used. The cells were stained for 30 minutes on ice and washed 3 times with PBS buffer before being incubated with appropriate secondary antibodies, which were coupled with a fluorescent detection reagent (goat anti-mouse phycoerythrin conjugate, CalTag Lab). The staining concentration was determined for each labeled antibody to provide a maximal Mean Fluorescence Intensity (MFI) and minimal background signal (e.g., optimum staining concentration was the concentration per $10^5$ cells). After 30 minutes incubation on ice, the cells were washed 3 times with PBS and analyzed by FACS. Specifically, cells were analyzed using a FACSCalibur flow cytometer and CellQuest software (BDIS, San Jose, Calif.).

First round libraries of recombinant nucleic acids were prepared according to this protocol. Recombinant nucleic acids encoding dengue virus PRM15/tE fusion proteins cloned into pMaxVax vectors, wherein such nucleic acid library-transfected cells were incubated with a human dengue virus antisera, were transfected into human 293 cell cultures and analyzed by standard FACS analyses, as described above, using a program that provides a graphical output of the number of positive cells against fluorescence intensity (software settings and dyes were selected such that dead cells were excluded from the output signal as were aggregated cell masses). The recombinant nucleic acids were produced by recursively recombining the following codon optimized dengue virus antigen parental nucleotide sequences with one another: Den-1PRM15-/tE CO, Den-2PRM15/tE CO, Den-3PRM15/tE CO, and Den-4PRM15/tE CO. Each library of recombinant PRM15/tE-encoding dengue virus nucleic acids comprised at least one recombinant nucleic acid that encoded a recombinant PRM15/tE dengue virus polypeptide that was bound by one or more murine anti-dengue virus antibodies. The experiments also included a population of 293 cells transfected with a pMaxVax10.1$_{null}$ vector (FIG. 1) lacking any dengue virus nucleic acid insertion (termed a "null vector") as a control (C) (data not shown).

Similar experiments were repeated with dengue virus antisera obtained from human patients (Immunology Consultants Laboratory Inc.—Sherwood, Oreg.) infected with dengue viruses (of unknown virus serotype(s)) (data no shown). Each library of recombinant PRM15/tE dengue virus nucleic acids also comprised at least one recombinant dengue virus nucleic acid that encoded a PRM15/tE dengue virus polypeptide that was bound by one or more human anti-dengue virus antisera.

To isolate such individual recombinant nucleic acids, individual E. coli colonies were picked from the plated libraries and inoculated into 96-well blocks containing 1.2 ml Terrific Broth-amp (50 μg/ml). The 96-well plate cultures were grown for 20 hours at 37° C., and plasmid DNA was purified using the Biorobot (Qiagen, Valencia, Calif.). HEK-293 cells were plated in 96-well plates at a density of $2\times10^4$ cells per well the day prior to transfections. The cells were transfected with individual recombinant pMaxVax10.1 vectors, each comprising a recombinant dengue virus nucleic acid, and a pMaxVax10.1$_{null}$ "null vector" as a control (which lacked a nucleic acid encoding a recombinant or WT dengue virus PRM15/tE), using a Superfect (Qiagen) transfection system according to the manufacturer's instructions. After about 48 hours incubation under conditions permissive for transgene expression, the transfected 293 cells were harvested or lysed using standard techniques, depending on the type of analysis to be performed on the cell or aspirated cell-free cell medium (supernatant) (e.g., whether the cells were subjected to FACS or Western blot analysis, as described further below).

Such techniques were used to screen or select from the libraries of recombinant polynucleotides produced by the above-described method to identify cells that comprised nucleic acids encoding polypeptides that reacted with specific dengue virus antibodies. Briefly, each well was analyzed with anti-dengue virus antibodies from mouse ascitic fluid against all four virus serotypes by FACS, as described above. Positive cells were counted in the FL2-H channel and graphically plotted. The graphical output obtained from these experiments was compared to the output obtained from similar experiments performed with the vector control (null vector). Cells that exhibited an intensity of at least about $10^2$ were considered positive for recombinant PRM15/tE dengue virus Ag expression (data not shown).

Plasmid DNAs of pMaxVax10.1 DNA vectors corresponding to positive clones identified in such 96-well high throughput screening assays were again transfected into 293 cells, and these cells were harvested and analyzed for tetravalent antigen expression against with the four serotype specific antibodies, as described below (Example 3).

The results of these experiments demonstrate that recursive sequence recombination and appropriately devised selection/screening procedures can be applied to DEN-1, DEN-2, DEN-3, or DEN-4 PRM15/tE CO (codon-optimized) antigen-encoding nucleic acids to generate libraries of novel recombinant nucleic acids and identify therefrom specific recombinant nucleic acids comprising nucleotide sequences that encode recombinant dengue antigens that reacted with murine and/or human dengue virus antibodies.

Example 3

This example describes the production and identification of recombinant nucleic acids that encode multivalent dengue antigens using recursive sequence recombination methods and chosen selection/screening procedures.

Clone 2/7 was selected from a library of clones comprising recombinant nucleic acids produced according to Example 2, after being identified as positive for the expression of a recombinant dengue antigen by FACS analysis. The nucleic acid sequence of clone 2/7, comprising a recombinant PRM15/trunE sequence is shown in SEQ ID NO:156. (The nucleic acid sequence of clone 2/7 comprising only the recombinant truncE nucleotide segment is shown in SEQ ID NO:285.)

Figure 4:
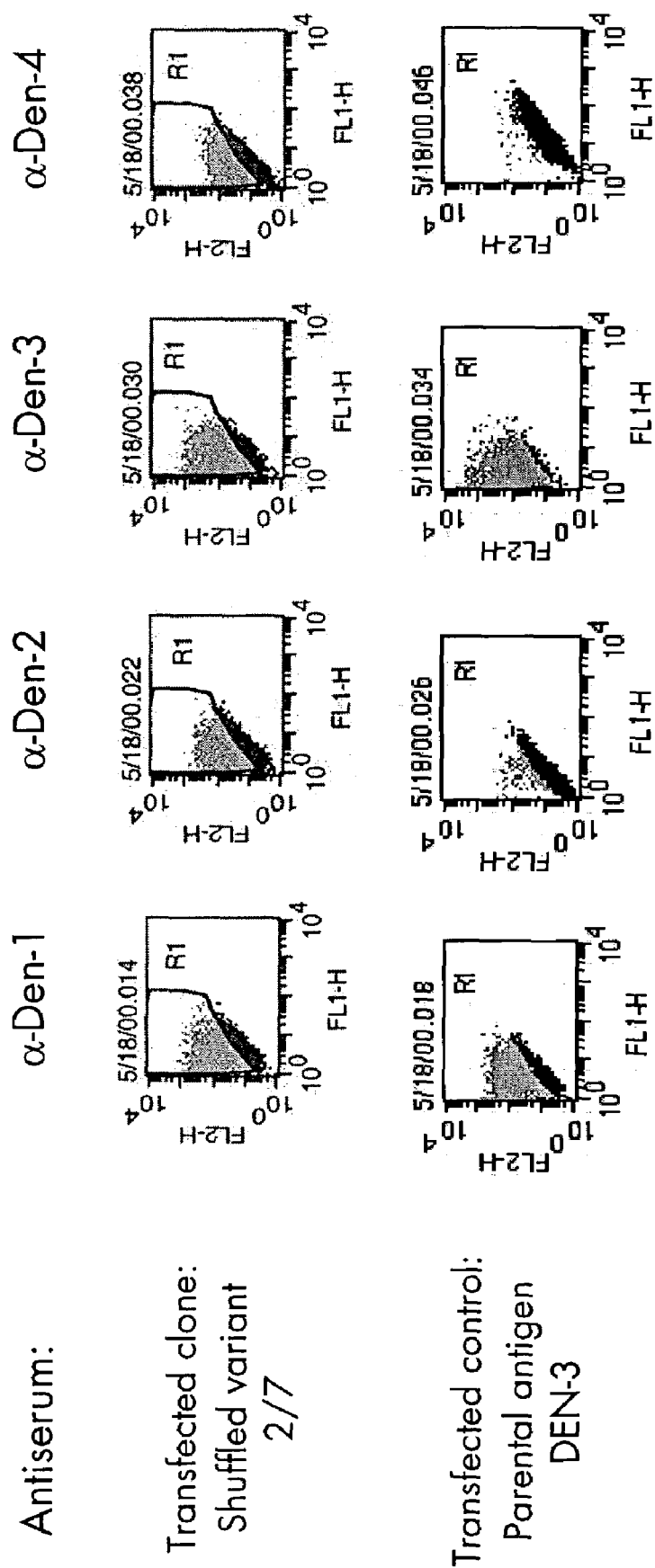
FIG. 4 includes a series of dot blots obtained by FACS analysis of 293 cells transfected with either pMaxVax10.1$_{2/7}$ vector or pMaxVax10.1$_{Den\text{-}3PRM15/tE\ CO}$ vector and separately incubated with mouse anti-DEN-1, DEN-2, DEN-3, or DEN-4 antisera.

293 cells were transfected with pMaxVax10.1$_{2/7}$ or pMaxVax10.1$_{Den-3PRM15/tE\ CO}$ using standard techniques and according to manufacturer's instructions, as described above. The transfected cells were cultured for about 48 hours under conditions permissive for nucleotide (e.g., transgene) expression, harvested, and divided into four for separate staining reactions. Serotype specific mouse DEN-1, DEN-2, DEN-3, and DEN-4 polyclonal antisera were then added to pMaxVax10.1$_{2/7}$ or pMaxVax10.1$_{Den-3PRM15/tE\ CO}$ transfected cells, followed by an incubation with appropriately labeled secondary antibodies, and the cells subjected to FACS analyses, as described in Example 2. The results of these experiments, which are shown in FIG. 4, demonstrate that the cloned recombinant nucleic acid of *E. coli* clone 2/7 (clone 2/7—SEQ ID NO:156), which encodes a recombinant antigen (SEQ ID NO:65) that is expressed on the surface of mammalian cells, is reactive with antibodies of all 4 dengue virus serotypes (i.e., tetravalent).

In comparison, Den-3PRM15/tE CO expressed an antigen having a WT DEN-3PRM15/truncated E fusion protein sequence (SEQ ID NO:151) that was reactive only with antibodies against DEN-3 and also cross-reactive with anti-DEN-1 antibodies.

These experimental results demonstrate the production of cell surface recombinant antigens that are cross-reactive with antibodies to all 4 serotypes of dengue viruses by one of the inventive methods of the invention. Moreover, the experiment illustrates an effective technique for identifying recombinant nucleic acids encoding multivalent antigens from a recombinant nucleic acid library produced according to the methods described herein.

Example 4

This example illustrates the identification of recombinant multivalent dengue antigens produced according to the methods described herein by Western blot analyses.

Six representative "PMR15/tE" clones (designated 2/7, 5/21, 2G11, 6E12, 6A11, and 6D8) identified as positive for the expression of recombinant dengue antigens by the methods described in Example 2 were selected. The recombinant nucleic acid-containing pMaxVax10.1 vectors corresponding to each of these 6 clones were isolated, as described above. Eleven cultures of 293 cells were prepared. Six cultures were transfected individually with one of the six pMaxVax10.1 vectors comprising a recombinant dengue PRM15/tE nucleotide sequence. Each of the remaining five cultures was transfected individually with one of the following vectors comprising a PRM15/tE CO parental nucleotide sequence—pMaxVax10.1$_{Den-1PRM15/tE\ CO}$, pMaxVax10.1$_{Den-2PRM15/tE\ CO}$, pMaxVax10.1$_{Den-3PRM15/tE\ CO}$, pMaxVax10.1$_{Den-4PRM15/tE\ CO}$ (collectively referred to as "parental sequences" or "parent sequences"), pMaxVax10.1$_{null}$ (vector control; no antigen-encoding sequence added)—under identical conditions. All transfections were performed using standard techniques and in accordance with manufacturers' instructions.

After about 48 hours incubation, under conditions permissive for nucleotide (e.g., transgene) expression, the transfected 293 cells were harvested, lysed and then separately subjected to polyacrylamide gel electrophoresis and Western blot analysis using mouse DEN-1, DEN-3, and DEN-4 antisera (designated α-DEN-1, α-DEN-3, and α-DEN-4, respectively) and appropriately labeled secondary antibodies, using the techniques described in Example 1. The results of these experiments are shown in FIG. 5.

Figure 5:
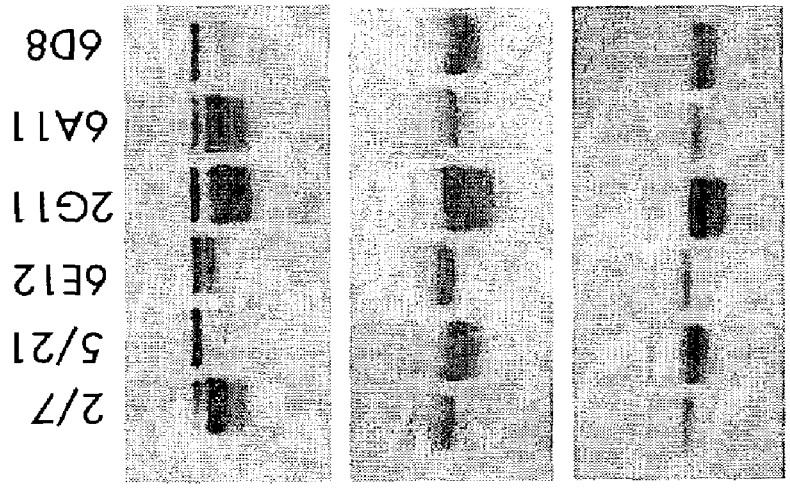
FIG. 5 is a Western blot of recombinant PRM15/truncated E dengue virus antigens of the invention expressed from a pMaxVax10.1 DNA vector, compared to PRM15/truncated E antigens having wild-type (wt) amino acid sequences expressed from pMaxVax10.1$_{Den\text{-}1PRM15/tE\ CO}$, pMaxVax10.1$_{Den\text{-}2PRM15/tE\ CO}$, pMaxVax10.1$_{Den\text{-}3PRM15/tE\ CO}$, and pMaxVax10.1$_{Den\text{-}4PRM15/tE\ CO}$ vectors, bound with DEN-1, DEN-3, and DEN-4 murine antisera and appropriate secondary antibodies. Nucleotide sequences encoding these recombinant PRM15/tE dengue virus antigens were screened or selected from among recombinant nucleotide sequences in recombinant libraries produced by recursive sequence recombination. In the figure, the letter "C" refers to a control vector and represents the data obtained by transfecting 293 cells with pMaxVax10.1$_{null}$ vector that does not include a dengue virus nucleotide sequence.

FIG. 5 shows that each of the selected recombinant nucleic acids encoded a secreted recombinant antigen that reacted with antibodies to DEN-1, DEN-3, and DEN-4. At best, only some of the parental nucleotide sequence-encoded antigens showed minimal cross-reactivity with antibodies other than those with which they are normally associated (see, e.g., the reactivity of Den-1PRM15/tE CO-encoded antigen with DEN-3 antibodies), resulting in a Western blot marked by light bands compared to the consistently well-defined bands observed with the six recombinant dengue antigens. Sequencing analysis determined that 2/7 and 6A11 were encoded by identical nucleic acid sequences, as were 5/21 and 6D8 explaining the remarkably similar banding patterns observed for these antigens.

The results of these experiments demonstrate an inventive method for producing and identifying (e.g., screening/selecting) recombinant secreted dengue antigens (comprising recombinant PRM15/tE fusion proteins or related recombinant truncated E proteins lacking the PRM15 sequence) that cross-react with (or bind or specifically bind to) anti-dengue virus antigen antibodies against multiple (e.g., at least two, at least three) dengue virus serotypes in mammalian cells.

Analogous procedures are used to produce and identify recombinant secreted dengue antigens comprising, e.g., recombinant C 15/full length prM/full length E fusion proteins (or related recombinant full length prM/full length E fusion proteins lacking the C15 sequence and the initial Met residue) that cross-react with (or bind or specifically bind to) anti-dengue virus antigen antibodies against at multiple dengue virus serotypes in subjects.

Example 5

This example describes methods to produce and identify (e.g., screening/selecting) recombinant dengue antigens that induce the production of antibodies to dengue viruses of multiple virus serotypes in vivo.

Nucleic acid libraries comprising recombinant polynucleotide sequences were produced using recursive sequence recombination techniques as described, e.g., in Example 2. pMaxVax10.1 plasmid vectors comprising members of the library of recombinant nucleic acid sequences (which encode PRM15/trunE dengue virus antigen fusion proteins) were constructed. In one aspect, at least sixteen recombinant antigens corresponding to 16 clones were identified as positive for the expression of tetravalent dengue antigens (e.g., dengue antigens reactive with all antibodies against all four serotypes) by FACS analysis described in Example 2. The pMaxVax10.1 plasmid vectors used for transformation of the clones were isolated and purified using the techniques described above for DNA immunization experiments, and then used for immunizations in mice as follows.

Inbred mice (BALB/c) were individually injected with endotoxin free purified (Qiagen) pMaxVax10.1 vector DNA comprising one of the sixteen recombinant nucleic acids or Den-3PRM15/tE CO. Three mice were injected with 50 μg of plasmid DNA of one of the indicated plasmid types in each leg muscle. Three mice received an identical dose of a control vector, pMaxVax10.1$_{null}$. All of the immunized mice received booster immunizations of identical dosage as the initial DNA immunization at day 14 after the initial immunization.

40 μl of serum was collected from each immunized mouse 28 days after the initial plasmid DNA injection and analyzed for antibody induction in ELISA assays. ELISA plates (Nunc Immuno Maxisorp (Roskilde—Denmark)) were coated overnight at 4° C. with the test antigens (inactivated dengue viruses of each serotype—Den-1, Den-2, Den-3, and Den-4—supplied by immunology Consultants Laboratory, Inc.—Sherwood, Oreg.) using standard techniques and according to the manufacturer's instructions. The plates were washed 3 times with PBS buffer containing 0.1% Tween 20 and blocked with 3% BSA/PBS/0.1% Tween20 for 1 hour at 37° C. to reduce unspecific binding. The plates were washed 3 times with PBS/0.1% Tween 20 and incubated for 1 hour at 37° C. with the anti-dengue test sera in a 1:100 dilution and after additional 3 washing steps incubated for 1 hour at 37° C. with the secondary antibodies (goat anti-mouse HRP conjugates, Amersham) at a 1:3000 dilution. The plates were finally washed 5 times with PBS/0.1% Tween 20 and incubated with TMB peroxidase substrates (Tetramethyl Benzidine, Pierce). The color reaction was stopped with 2M $H_2SO_4$, and the optical density (absorbance) for each sample was analyzed spectrophotometrically at 450 nanometers (nm) on an ELISA plate reader. Alternatively, ELISA assays can be performed by using other standard assay formats, including, e.g., that described in Raviprakash et al., *J. Gen. Virology* 81:1659-1667 (2000), which is incorporated herein by reference in its entirety for all purposes).

A least seven of the sixteen recombinant PRM15/tE dengue virus antigen-encoding nucleic acids tested—2G11 (SEQ ID NO:157), 2/7 (also termed "6A11")(SEQ ID NO:156), 6E12 (SEQ ID NO:159), 6C6 (SEQ ID NO:160), 5/21 (also termed "6D8") (SEQ ID NO:158), 6F4 (SEQ ID NO:161), and 7A9 (SEQ ID NO:162), were identified as encoding seven respective recombinant antigens (i.e., 2G11 (SEQ ID NO:66), 2/7 (6A 11)(SEQ ID NO:65), 6E12 (SEQ ID NO:69), 6C6 (SEQ ID NO:68), 5/21 (6D8) (SEQ ID NO:67), 6F4 (SEQ ID NO:70), and 7A9 (SEQ ID NO:71) that, upon expression in vivo, produced antibodies against DEN-1, DEN-2, DEN-3, and DEN-4 that were detected in a standard ELISA assay. The signal peptide sequence is typically cleaved after transport of the tE protein into the ER.

The average optical density (OD) values for each of these seven tetravalent antigens were calculated for each serotype-specific ELISA plate tested. These values were plotted on a graph along with the average OD values observed for mice injected with pMaxVax10.$1_{Den\text{-}3PRM15/tE\ CO}$ and pMaxVax10.$1_{null}$ on each of the dengue virus serotype-specific ELISA plates (data not shown). Representative data for four of these recombinant tetravalent antigens, 2G11, 2/7, 6E12, 5/21) are shown in FIG. 6 (Example 6). In this figure, pMV refers to pMaxVax10.$1_{null}$.

In vivo injection of each mouse with a population of pMaxVax10.1 DNA plasmid expression vectors, wherein each said population of vectors comprised one such recombinant dengue antigen-encoding nucleotide sequence, resulted in the production of antibodies that reacted with multiple serotype-specific dengue antigens in the standard ELISA. For example, antisera that were obtained from immunized mice, wherein each such mouse had been injected with a population of pMaxVax10.1 vectors, each of said population of vectors comprising one of the following recombinant DNA sequences—2G11 DNA, 2/7 (6A11) DNA, 5/21 (6D8) DNA, or 6E12 DNA, produced higher OD levels than antisera that were obtained from mice injected with a population of pMaxVax10.$1_{Den\text{-}1PRM15/tE\ CO}$ expression vectors, and tested on ELISA plates, coated with inactivated DEN-1 virus. Significantly, sera obtained from mice immunized with any of the seven of these plasmids, each comprising one of the seven recombinant antigen-encoding DNA sequences, exhibited higher OD levels than sera obtained from mice immunized with pMaxVax10.$1_{Den\text{-}2PRM15/tE}$ when analyzed on inactivated DEN-2 virus coated ELISA plates. Moreover, OD levels for sera obtained from mice immunized with pMaxVax10.$1_{2/7}$ DNA, pMaxVax10.$1_{5/21}$ DNA, pMaxVax10.$1_{2G11}$ DNA, pMaxVax10.$1_{6E12}$ DNA, were also higher than those observed for sera obtained from mice immunized with pMaxVax10.$1_{Den\text{-}3PRM15/tE\ CO}$ and assayed on inactivated DEN-3 virus coated ELISA plates. OD levels for the plasmids comprising the shuffled DNA-encoded antigens pMaxVax10.$1_{2G11}$ DNA and pMaxVax10.$1_{6E12}$ DNA were at least comparable to those of mice injected with pMaxVax10.$1_{Den\text{-}4PRM15/tE}$ when assayed on inactivated DEN-4 virus coated ELISA plates.

The results of this experiment demonstrate the effectiveness of recursive sequence recombination and appropriate screening/selection assays in generating and identifying nucleic acids encoding recombinant (PRM15/tE) dengue antigens that upon expression in vivo induce or promote the production of antibodies that react with (or bind or specifically bind to) dengue virus antigens of multiple dengue virus serotypes. The results also demonstrate that recombinant nucleic acids of the invention (and recombinant antigens encoded therefrom) are useful and effective in inducing or promoting the production of antibodies that react with (or bind or specifically bind to) dengue virus antigens of multiple dengue virus serotypes in vivo in subjects, including mammals.

Example 6

This example illustrates the generation of a library of recombinant nucleic acids by a second round of recursive sequence recombination, and the identification and/or isolation of recombinant nucleic acids encoding recombinant dengue antigens from the library which, when expressed in vivo, induce or enhance the production of antibodies to dengue viruses of multiple dengue virus serotypes.

The seven nucleic acids identified as encoding tetravalent antigens in Example 5 (PRM15/trunE format) were isolated, purified, and subjected to a second round of recursive sequence recombination (e.g., DNA shuffling and appropriately defined selection/screening) to produce a first second round library of recombinant nucleic acids (PRM15/trunE format), all of which were cloned in *E. coli*.

In one exemplary analysis, at least twenty-one recombinant nucleic acids (PRM15/trunE format) in a resulting library were identified as encoding recombinant polypeptides that reacted with dengue virus antibodies of at least three dengue virus serotypes by testing for antibody-antigen binding using the serotype specific anti-Dengue virus-types 1-4 antisera in FACS analyses performed under similar conditions as related experiments described in Examples 1-3. The twenty-one nucleic acid sequences were isolated, purified, and ligated into pMaxVax10.1 vectors, in accordance with the techniques applied in Example 1 (see, e.g., FIG. 2). The recombinant pMaxVax10.1 plasmids were cloned in *E. coli* to generate plasmids for the following DNA immunization experiments.

A group of three mice was injected with 100 μg of plasmid DNA for each one of the identified 21 pMaxVax10.1 plasmid vectors, each such vector comprising a shuffled DNA sequence, or with the control vector, pMaxVax10.1$_{null}$. Each mouse received a booster immunization of the same dose of the same vector as the initial immunization at day 14, and was subsequently bled on day 28 to obtain sera, according to the method described in Example 5. Sera obtained from the immunized mice were analyzed in a 1:100 dilution in PBS for antibody induction in ELISA assays on DEN-1, DEN-2, DEN-3, and DEN-4 inactivated virus coated ELISA plates, respectively, as described in Example 5. At least twelve of the nucleic acid sequences (PRM15/truncE format), 11B1 DNA (SEQ ID NO:173), 11B8 DNA (SEQ ID NO:174), 11C11 DNA (SEQ ID NO:176), 11E2 DNA (SEQ ID NO:163), 12E3 DNA (SEQ ID NO:164), 12H4 DNA (SEQ ID NO:177), 13E2 DNA (SEQ ID NO:165), 13E11 DNA (SEQ ID NO:167), 13F11 DNA (SEQ ID NO:178), 14B1 DNA (SEQ ID NO:179), 14E9 DNA (SEQ ID NO:166), and 14H2 DNA (SEQ ID NO:181), were identified by ELISA as encoding recombinant antigens, 11B1 (SEQ ID NO:72), 11B8 (SEQ ID NO:73), 11C11 (SEQ ID NO:75), 11E2 (SEQ ID NO:76), 12E3 (SEQ ID NO:77), 12H4 (SEQ ID NO:78), 13E2 (SEQ ID NO:79), 13E11 (SEQ ID NO:80), 13F11 (SEQ ID NO:81), 14B1 (SEQ ID NO:82), 14E9 (SEQ ID NO:83), and 14H2 (SEQ ID NO:85), that induced in vivo production of antibodies that reacted with dengue virus antigens of the four virus serotypes—Den-1, Den-2, Den-3, and Den-4—at levels well above those observed with the control vector.

Figure 6:
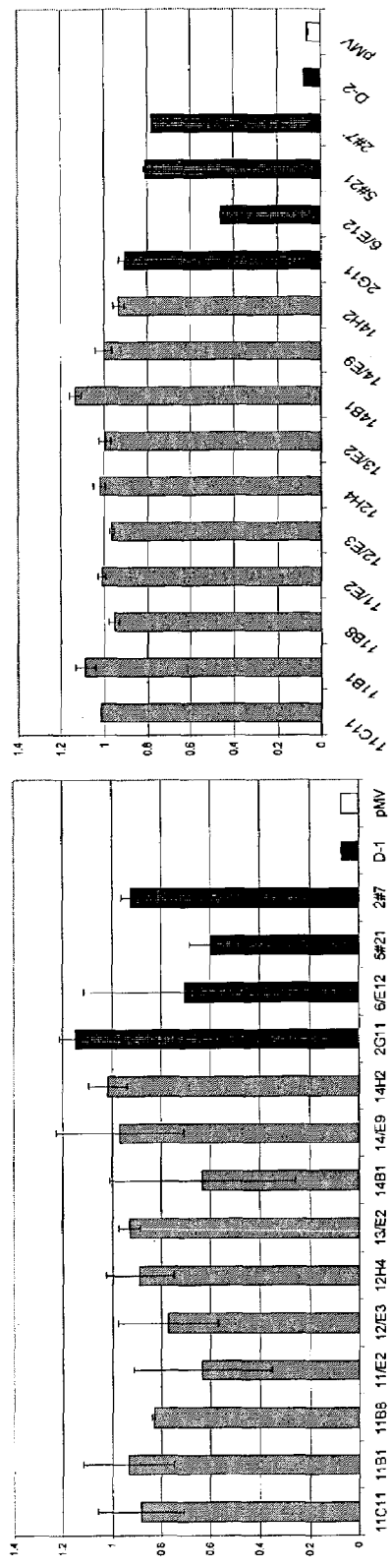
FIG. 6 shows the optical density (OD) values obtained by ELISA analysis of antisera obtained from mice, each of which had been injected with a pMaxVax10.1 vector comprising a representative recombinant (e.g., shuffled) nucleic acid sequence identified in libraries of recombinant nucleic acids using ELISA plates, coated with inactivated DEN-1, DEN-2, DEN-3, and DEN-4 viruses. The term "WT" refers to a pMaxVax10.1 vector comprising a nucleic acid sequence encoding PRM15/truncated envelope protein of a wild-type DEN-1, DEN-2, DEN-3, or DEN-4 polyprotein, respectively. The control vector comprises a pMaxVax10.1$_{null}$ vector (termed "pMV") lacking any dengue virus nucleic acid sequence.
Figure 6:
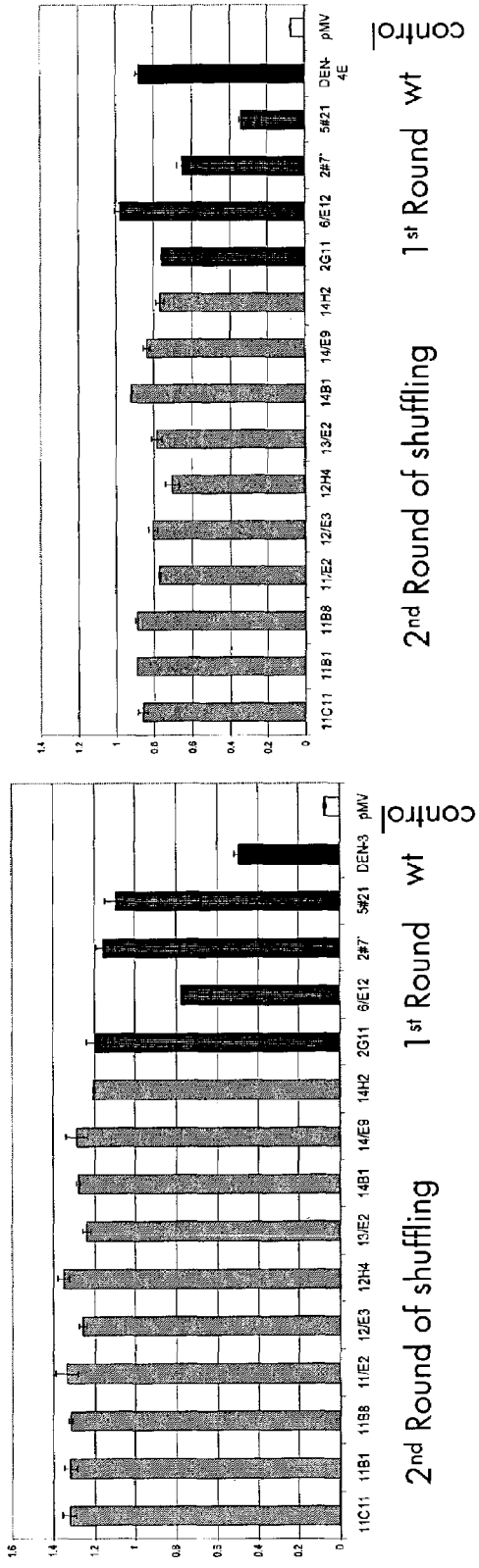

In a further round of experiments, mice were individually injected with 100 μg of plasmid DNA of one of the following: (1) ten representative plasmids (each comprising one of the 11B1, 11B8, 11C11, 11E2, 12E3, 12H4, 13E2, 14B1, 14E9, and 14H2 nucleotide sequences), (2) plasmids comprising four parental nucleotide sequences described in Example 1 (i.e., pMaxVax10.1$_{Den-1PRM15/tE\ CO}$, pMaxVax10.1$_{Den-2PRM15/tE\ CO}$, pMaxVax10.1$_{Den-3PRM15/tE\ CO}$, and pMaxVax10.1$_{Den-4PRM15/tE\ CO}$), (3) plasmids comprising four select nucleic acids (2G11 DNA (SEQ ID NO:157), 6E12 DNA (SEQ ID NO:159), 5/21 DNA (SEQ ID NO:158), and 2/7 DNA (SEQ ID NO:156)), or (4) the pMaxVax10.1$_{null}$ plasmid vector. The immunization experiments were performed in triplicate with booster immunizations and bleeding performed as described in Example 5. Sera obtained from the immunized mice were analyzed for antibody induction in ELISA assays on DEN-1, DEN-2, DEN-3, and DEN-4 inactivated virus coated ELISA plates, respectively, as described in Example 5. Average OD values for sera obtained from groups of mice, each group comprised 3 mice, which had been immunized with one type of plasmid against each type of ELISA plate were determined and graphically plotted. The results of these calculations are shown in FIG. 6. In this figure, the label "pMV" on the X axis of each plot refers to pMaxVax10.1$_{null}$, and the labels "D-1," "D-2," "Den-3," and "Den-4E" on the X axes refer to pMaxVax10.1$_{Den-1PRM15/tE\ CO}$, pMaxVax 10.1$_{Den-2PRM15/tE\ CO}$, pMaxVax 10.1 Den-3PRM 15/tE CO, and pMaxVax10.1$_{Den-4PRM15/tE\ CO}$, respectively.

The results of these experiments, as shown in FIG. 6, demonstrate that all of the selected nucleic acids expressed antigens that induced antibodies in mice that strongly reacted with all four inactivated WT dengue viruses (Den-1, Den-2, Den-3, and Den-4) in ELISA assays. Sera obtained from mice injected with plasmids comprising the selected second round library nucleic acid sequences exhibited higher average OD values on DEN-1, DEN-2, and DEN-3 ELISA plates than did the most related parental sequence; for example, sera from mice immunized with the second round recombinant nucleic acids had higher average OD values on the DEN-1 plate than the average OD of mouse sera obtained from mice immunized with pMaxVax10.$1_{Den\text{-}1PRM15/tE\ CO}$ (labeled as D-1 in FIG. 6). Furthermore, sera from mice that received injections of pMaxVax10.1 plasmid DNA comprising at least 4 of the first second round nucleic acids—11C1-encoding DNA, 11B1 DNA, 11B8 DNA, and 14B1 DNA—as well sera obtained from mice that received injections of at least pMaxVax10.$1_{6E12}$ DNA, exhibited OD levels comparable to those levels observed with sera from mice that received injections of pMaxVax10.$1_{Den\text{-}4PRM15/tE\ CO}$ analyzed on DEN-4 specific ELISA plates.

The results of these experiments further demonstrate generation and identification of recombinant nucleic acids encoding recombinant (PRM15/tE) dengue antigens that induce or enhance production of antibodies that react with (or bind or specifically bind to) multiple dengue virus serotypes in vivo (as identified by the selecting screening methods described herein). The results of these experiments also confirm that the nucleic acids and plasmid vectors of the invention (and the resulting recombinant polypeptides encoded therefrom) are capable of and useful for inducing and enhancing such an immune response(s) in vivo in subjects, including mammals.

Example 7

This example illustrates the complex chimerism (i.e., sequence diversity) of select recombinant antigens of the invention where the amino acid sequences of such recombinant antigens are compared to amino acid sequences of corresponding WT dengue virus antigens.

The antigens corresponding to the recombinant nucleotide sequences of the seven clones identified and selected as examples in the first round recombinant nucleotide library in Example 5 (i.e., 2/7 (also termed "6A11"), 5/21 (also termed "6D8"), 2G11, 6E12, 6C6, 6F4, and 7A9) and the antigens corresponding to the recombinant nucleotide sequences of the 12 clones identified and selected in the first second round recombinant nucleotide library in Example 6 (11B1, 11B8, 11C11, 11E2, 12E3, 12H4, 13E2, 13E11, 13F11, 14B1, 14E9, and 14H2) were sequenced and compared with the polypeptide sequences of the corresponding sequence regions (i.e., the PRM15 and truncated E protein (e.g., about 90% of the N terminus of the E protein)) of each wild-type dengue antigen for each of the 4 dengue serotypes to determine regions of amino acid sequence identity between the recombinant and wild-type antigens using standard techniques. Through such analysis, it was determined that the recombinant antigens included, e.g., various amino acid regions, fragments, or segments from the wild-type PRM15/truncated envelope protein polypeptide sequence for each of the 4 WT dengue virus serotypes. Approximate amino acid regions, fragments or segments in a recombinant antigen corresponding to a region, fragment or segment of a wild-type antigen amino acid sequence were graphically plotted to assess chimerism of the recombinant antigens (data not shown) (see, however, the exemplary plot shown in FIG. 11). Additionally, it was noted that diversity increased with additional recursive sequence recombination, e.g., via DNA shuffling in combination with appropriate screening or selection procedures.

The above-described amino acid sequence analysis illustrates the complex chimeric nature (sequence diversity) of at least many of the recombinant antigens of the invention and nucleic acids encoding them. Moreover, the results of this sequence analysis establish that greater diversity (more complex chimerism) is induced in recombinant antigens encoded by DNAs produced and identified via multiple rounds of recursive sequence recombination combined with appropriate screening/selection procedures.

Example 8

This example describes the generation of a library of recombinant nucleic acids by recursive sequence recombination, the identification of select recombinant nucleic acids in such library using appropriate screening/selection procedures, and the isolation of selected nucleic acids encoding recombinant dengue antigens from the library, which, when expressed in vivo, induced or enhanced the production of antibodies that reacted with dengue viruses of multiple virus serotypes.

Representative recombinant dengue-antigen-encoding nucleic acid sequences from first round library clones 2G11, 6E12, 2/7 (6A11), and 5/21 (6A8), described in Example 5, were isolated and purified using standard techniques and, in combination with the 4 parental dengue sequences described in Example 1, used to produce a new library of recombinant nucleic acids by recursive sequence recombination in accordance with the techniques described and/or referenced in Example 2 and throughout the specification.

From this library of recombinant nucleic acids, twenty-five recombinant nucleotide sequences (in PRM15/tE format)) were selected via flow cytometry (FACS) for immunization of mice and ELISA analyses of the sera using four serotype-specific inactivated dengue virus coated ELISA plates following the techniques described and referenced in Example 5. All 25 recombinant nucleotide sequences were analyzed as such and found to induce or enhance production of cross-reactive antibodies against all 4 DEN serotypes as discussed in detail below.

Specifically, twenty-five recombinant DNA sequences (in PRM15/tE format)—(15C2 DNA (SEQ ID NO:182), 15D4 DNA (SEQ ID NO:183), 15H4 DNA (SEQ ID NO:184), 16B4 DNA (SEQ ID NO:185), 16E8 DNA (SEQ ID NO:168), 16E10 DNA (SEQ ID NO:169), 16F12DNA (SEQ ID NO:186), 16G11 DNA (SEQ ID NO:187), 17A12 DNA (SEQ ID NO:188), 17D5 DNA (SEQ ID NO:189), 17D11 DNA (SEQ ID NO:190), 17F5 DNA (SEQ ID NO:191), 17F11 DNA (SEQ ID NO:192), 17G5 DNA (SEQ ID NO:193), 17H3 DNA (SEQ ID NO:194), 17H10 DNA (SEQ ID NO:195), 17H12 DNA (SEQ ID NO:196), 18A9 DNA (SEQ ID NO:197), 18B7 DNA (SEQ ID NO:198), 18D7 DNA (SEQ ID NO:199), 18E9 DNA (SEQ ID NO:170), 18E10 DNA (SEQ ID NO:171), 18E11 1 DNA (SEQ ID NO:172), 18H2 DNA (SEQ ID NO:200), and 18H6 DNA (SEQ ID NO:235))—were isolated from the new library of recombinant nucleic acids using techniques as described in Examples 1-7. A pMaxVax10.1 plasmid vector comprising each such recombinant DNA sequence was prepared as described above.

Mice were divided into groups of three. Three mice were each immunized by injection with one of the following DNA constructs: (1) 100 μg of pMaxVax10.1 plasmid DNA vector comprising one of the 25 recombinant sequences described above; (2) 100 μg of pMaxVax 10.1 plasmid vector comprising the recombinant DNA sequence corresponding to clone 11C4 (SEQ ID NO:175) identified in a first second round library (see Example 5); (3) 100 μg of pMaxVax 10.1 plasmid vector comprising the recombinant DNA sequence corresponding to clone 14G10 DNA (SEQ ID NO:180) identified in a first second round library (see Example 5), and (4) 100 μg of pMaxVax10.1$_{null}$ vector (control). Each mouse received a booster of the same dose of the same plasmid vector as the initial immunization at days 14, 29, and 56 following the initial immunization (day 0). Sera were collected from the mice at days 28, 55, and 76. The collected sera were analyzed for in vivo antibody induction in ELISA assays on DEN-1, DEN-2, DEN-3, and DEN-4 inactivated virus coated ELISA plates in a 1:100 dilution under conditions described in Example 5.

The ELISA analyses of the mouse sera indicated that all 27 plasmids (each comprising one of the PRM15/tE recombinant nucleotide sequences described above) lead to in vivo expression of antigens that induced production of antibodies that reacted with inactivated dengue viruses of all 4 virus serotypes in ELISA assays at both 28 and 55 days after injection. The average optical density (OD) value for each recombinant PRM15/tE antigen encoded by such recombinant plasmid vector was calculated for the sera obtained from each mice receiving such plasmid injection(s) for each serotype-specific ELISA plate tested, as compared to that value obtained using pMaxVax10.1$_{null}$ (data not shown). The 25 recombinant PMR15/tE polypeptide antigens encoded by the recombinant nucleotide sequence identified in the new library included the following: (15C2 (SEQ ID NO:86), 15D4 (SEQ ID NO:87), 15H4 (SEQ ID NO:88), 16B4 (SEQ ID NO:89), 16E8 (SEQ ID NO:90), 16E10 (SEQ ID NO:91), 16F12 (SEQ ID NO:92), 16G11 (SEQ ID NO:93), 17A12 (SEQ ID NO:94), 17D5 (SEQ ID NO:95), 17D11 (SEQ ID NO:96), 17F5 (SEQ ID NO:97), 17F11 (SEQ ID NO:98), 17G5 (SEQ ID NO:99), 17H3 (SEQ ID NO:100), 17H10 (SEQ ID NO:101), 17H12 (SEQ ID NO:102), 18A9 (SEQ ID NO:103), 18B7 (SEQ ID NO:104), 18D7 (SEQ ID NO:105), 18E9 (SEQ ID NO:106), 18E10 (SEQ ID NO:107), 18E11 (SEQ ID NO:108), 18H2 (SEQ ID NO:109), and 18H6 (SEQ ID NO:110).

Figure 7:
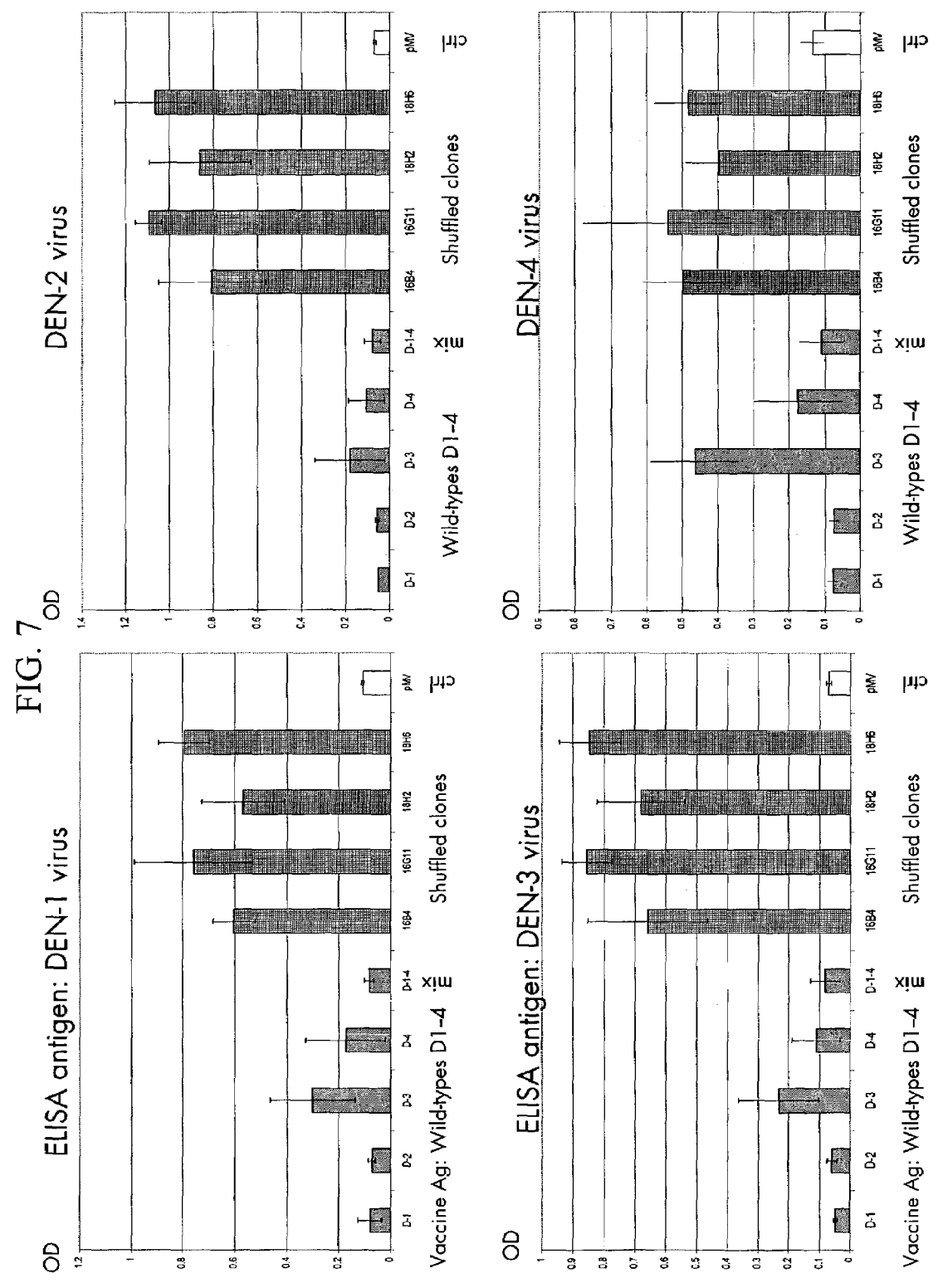

A further in vivo analysis was performed by injecting groups of 5 mice each under identical conditions with 100 μg (50 μg/leg) of pMaxVax 10.1$_{null}$ or with 100 μg pMaxVax 10.1 DNA vector comprising one of the following nucleotide sequences: 16B4 (SEQ ID NO:185), 16G11 (SEQ ID NO:187), 18H2 (SEQ ID NO:200), 18H6 (SEQ ID NO:235), Den-1PRM15/tE CO (SEQ ID NO:211), Den-2PRM15/tE CO (SEQ ID NO:212), Den-3PRM15/tE CO (SEQ ID NO:213), Den-4PRM15/tE CO (SEQ ID NO:214). Each mouse of another group of 5 mice was injected with 100 μg (50 μg/leg) of a mixture of pMaxVax10.1$_{Den-1PRM15/tE\,CO}$, pMaxVax10.1$_{Den-2PRM15/tE\,CO}$, pMaxVax10.1$_{Den-3PRM15/tE\,CO}$, and pMaxVax10.1$_{Den-4PRM15/tE\,CO}$ at the same times and under the same conditions as described for the other groups of mice that received individual injections of each of the above-described plasmid DNA vectors. Each mouse received a booster immunization of the same dose of the same plasmid vector as the initial immunization at days 14, 29, and 56 following the initial immunization (day 0). Sera were collected from the mice at days 28, 55, 76, 120 and 180. Average OD values from sera at day 55 obtained for the experiments are shown in FIG. 7.

The results of these further ELISA assays indicate that the recombinant PRM15/tE antigens (16B4 (SEQ ID NO:89), 16G11 (SEQ ID NO:93), 18H2 (SEQ ID NO:109), 18H6 (SEQ ID NO:110)) encoded by the selected recombinant nucleotides (16B4 (SEQ ID NO:185), 16G11 (SEQ ID NO:187), 18H2 (SEQ ID NO:200), 18H6 (SEQ ID NO:235)) induced production of antibodies that reacted with dengue viruses of all 4 WT dengue virus serotypes. OD levels exhibited by antisera from mice injected with these selected recombinant clones were significantly higher than those produced by antigens (Den-1PRM15/tE (SEQ ID NO:149), Den-2PRM15/tE (SEQ ID NO:150), Den-3PRM15/tE (SEQ ID NO:151), Den-4PRM15/tE (SEQ ID NO:152)) encoded by any of the parental nucleotide sequences (Den-1PRM15/tE CO (SEQ ID NO:211), Den-2PRM15/tE CO (SEQ ID NO:212), Den-3PRM15/tE CO (SEQ ID NO:213), Den-4PRM15/tE CO (SEQ ID NO:214)), individually or in combination, for the DEN-1, DEN-2, and DEN-3 virus coated ELISA plates. Antisera from mice injected with plasmids comprising these recombinant antigen-encoding sequences also had OD levels at least as high as any of these parental antigen-encoding sequences against DEN-4 (individually or in combination) (high OD levels exhibited by sera obtained from $pMaxVax10.1_{Den-3PRM15/tE\ CO}$-injected mice on such plate may suggest a flaw in the ELISA plate used for this portion of the experiment).

The results of these experiments further demonstrate the ability of the recombinant antigens of the invention, and/or recombinant nucleic acids of the invention that encode recombinant antigens, to induce or enhance production of antibodies that react with (or bind or specifically bind to) dengue viruses of all four serotypes in vivo. Such recombinant antigenic polypeptide sequences of the invention, and such recombinant nucleotide sequences encoding recombinant antigenic polypeptides of the invention, are useful, e.g., in prophylactic and/or therapeutic methods of the invention for the induction, modulation, and/or enhancement of the production of antibodies that react with (or bind or specifically bind to) dengue viruses of all four serotypes and/or diagnostic assays to detect the presence of antibodies in a biological sample to 1, 2, 3, and 4 dengue virus serotypes.

Example 9

This example describes the ability of recombinant antigens of the invention to produce, enhance, modulate, and/or promote a neutralizing antibody response(s) against dengue viruses of multiple dengue virus serotypes in vivo.

Mice were individually injected with a pMaxVax10.1 plasmid vector comprising a recombinant DNA sequence corresponding to one of the following—18E9 (SEQ ID NO:170), 18D7 (SEQ ID NO:199), 16G11 (SEQ ID NO:187), 18H6 (SEQ ID NO:235), 15D4 (SEQ ID NO:183), 18H2 (SEQ ID NO:200), 6E12 (SEQ ID NO:159), 2/7 (SEQ ID NO:156), 2G11 (SEQ ID NO:157), and 16B4 (SEQ ID NO:185)— according to the methods set forth in Example 8. These DNA sequences encoded the following recombinant PRM15/tE antigens, respectively: 18E9 (SEQ ID NO:106),), 18D7 (SEQ ID NO:105), 16G11 (SEQ ID NO:93), 18H6 (SEQ ID NO:110), 15D4 (SEQ ID NO:87), 18H2 (SEQ ID NO:109), 6E12 (SEQ ID NO:69), 2/7 (SEQ ID NO:65), 2G11 (SEQ ID NO:66) and 16B4 (SEQ ID NO:89). In a similar experiment DEN-1, DEN 2, DEN-3, and DEN-4 wild type sequences, coding for the DEN-1-4 wild-type PRM15/tE antigens, and a equal mix of these 4 wild-type antigens were injected. All mice received 3 booster injections with the same plasmid DNA in 2-week intervals.

Mice were also individually injected with a pMaxVax10.1 plasmid vector comprising a recombinant DNA sequence corresponding to one of the following—5/21-D1 (SEQ ID NO:201), 2G11-D4 (SEQ ID NO:204), and 6E12-D4 (SEQ ID NO:202). These DNA sequences encoded the following recombinant full length C15/full prM/full length E antigens, respectively: following—5/21-D1 (SEQ ID NO:140), 2G11-D4 (SEQ ID NO:139), and 6E12-D4 (SEQ ID NO:141). In a similar experiment DEN-1, DEN-2, DEN-3, and DEN-4 wild type sequences, coding for the wild-type C15/full prM/full length E antigens, and a equal mix of these 4 wild-type antigens were injected. All mice received 3 booster injections with the same plasmid DNA in 2-week intervals.

Antisera obtained from the mice 76 days after initial DNA injection were analyzed by standard plaque reduction neutralization titer (PRNT) assay, which is well known to those of ordinary skill in the art (see, e.g., Russell et al., *J Immunol* (1967) 99:285-290; Simmons et al, Am. J. Trop. Med. Hyg (2001) 65:420-426), each incorporated herein by reference in its entirety for all purposes.

Briefly, this $PRNT_{50}$ assay is typically conducted as follows: Cell cultures of monkey kidney cells (LLC-MK2) are seeded in 6 well culture plates and incubated at 37° C. in a $CO_2$ incubator. Each of the antisera obtained from the mice injected with one of the 9 plasmid vectors is diluted to make 1:20, 1:40, and 1:80 serial dilutions. Each cell culture is incubated with a mixture of (i) dengue viruses of each of the four 4 dengue virus serotypes and (ii) a 1:20, 1:40, or 1:80 serial dilution of antisera for 2 to 3 hours.

After incubation of 2-3 hours, the inoculum mixture of dengue viruses and diluted antisera are removed from the LLC-MK2 monkey kidney cell cultures, and a layer of agarose (SeaPlaque agarose, FMC Bioproducts) is added to the cell cultures. Plaques formed by the released virus progeny are visualized at day 7 by staining with a 0.02% neutral red/Hanks balanced salt solution. The plaque counts for each such cell culture are compared to plaque counts for LLC-MK2 cells incubated with an identical mixture of dengue viruses without any antisera. The specific determination of 50% plaque reduction neutralization titers ($PRNT_{50}$) for the cultures is facilitated by use of Probit analysis software (SSPS, Inc. Chicago, Ill.), using standard techniques and according to manufacturer's instructions. The 50% effective dose ($ED_{50}$) is the serum dilution that caused a 50% reduction in the number of plaques. The amount of antiserum (e.g., serum from a subject containing specific antibodies produced by immunization with a specific immunogen) required to neutralize 50% of the infectious virus particles included in a specific virus challenge dose is directly related to the potency of the antiserum. Russell et al., supra, at 286.

FIG. 8A shows the results of $PRNT_{50}$ analyses for these 10 recombinant PRM15/tE antigen-encoding DNA sequences (e.g., clones 18E9, 18D7, 16G11, 18H6, 15D4, 18H2, 6E12, 2/7, 2G11, and 16B4), the four DEN wild-type PRM15/tE antigens (DEN-1, DEN-2, DEN-3, and DEN-4) individually, and an equal mix of these four DEN wild-types. FIG. 8B shows the results of $PRNT_{50}$ analyses for these 3 recombinant full length C15/full prM/full length E antigen-encoding DNA sequences (e.g., clones 5/21-D1, 2G11-D4, and 6E12-D4), the four DEN wild-type C15/full prM/full length E antigens (DEN-1, DEN-2, DEN-3, and DEN-4) individually, and an equal mix of these four DEN wild-types. Reciprocal $PRNT_{50}$ titers of >20 were regarded as positive for production of neutralizing antibodies against a particular dengue virus serotype used for the in vitro neutralization assay. Applying this standard to the $PRNT_{50}$ titers presented in FIGS. 8A and 8B, all 13 of these recombinant plasmid vectors induced production of neutralizing antibodies against at least 2 dengue viruses (e.g., against at least two of DEN-1, DEN-2, DEN-3, and/or DEN-4). For example, injection of mice with $pMaxVax10.1_{18E9}$, induced neutralizing antibodies against at least DEN-1 and DEN-2. Injection of mice with $pMaxVax10.1_{18D7}$, $pMaxVax10.1_{15D4}$, and $pMaxVax10.1_{6E12}$ induced neutralizing antibodies against at least DEN-1, DEN-2, and DEN-3. Injection of mice with $pMaxVax10.1_{2/7}$, $pMaxVax\ 10.1_{2G11}$, $pMaxVax\ 10.1_{16G11}$, $pMaxVax10.1_{18H6}$, $pMaxVax10.1_{18H2}$, and pMaxVax10.1$_{16B4}$, pMaxVax10.1$_{5/21-D1}$, pMaxVax10.1$_{2G11-D4}$, and pMaxVax 10.1$_{6E12-D4}$ induced production of neutralizing antibodies against all four dengue virus serotypes, DEN-1, DEN-2, DEN-3, and DEN-4. In contrast, only a mix of the wild-type DEN-1, DEN-2, DEN-3, and DEN-4, coding for the recombinant full length C15/full prM/full length E antigens, induced production of neutralizing antibodies against all four dengue virus serotypes, DEN-1, DEN-2, DEN-3, and DEN-4. The two DEN wild-type PRM15/tE antigens DEN-1, and DEN-2, as well as a mix of the four DEN wild-type PRM15/tE antigens (DEN-1, and DEN-2, DEN-3, and DEN-4), and the two DEN-wild-type full length C15/full prM/full length E DEN-1, and DEN-2 antigens, did not induce neutralizing antibodies. The two DEN wild-type PRM15/tE antigens DEN-3, and DEN-4 induced only neutralizing antibodies against the homologous DEN-virus (DEN-1 and DEN-2, respectively), while the two DEN wild-type full length C15/full prM/full length E antigens, DEN-3, and DEN-4, induced neutralizing antibodies against at least 3 Den viruses (DEN-2, DEN-3, and DEN-4).

ELISA analyses were also performed with sera obtained from mice injected with 100 μg pMaxVax10.1 plasmid vector comprising a recombinant nucleotide sequence corresponding of one of each of these 13 clones (clones 18E9, 18D7, 16G11, 18H6, 15D4, 18H2, 6E12, 2/7, 2G11, 16B4, 5/21-D1, 2G11-D4, and 6E12-D4) and sera obtained from mice injected with pMaxVax10.$1_{null}$ using DEN-1, DEN-2, DEN-3, and DEN-4 virus coated ELISA plates and DNA immunization techniques according to the methods described in Example 8. The resulting ELISA data demonstrated that all 13 of these recombinant clones induced production of antibodies in vivo that reacted with all four dengue virus serotypes in vitro (data not shown).

The results of these experiments demonstrate that the recombinant nucleotide sequences encoding recombinant dengue antigens (for the PRM15/tE format and the C15/full prM/full length E format) of the invention and/or recombinant dengue antigens ((for the PRM15/tE format and the C15/full prM/full length E format)) of the invention induced, enhanced, promoted, and/or modulated production of neutralizing antibodies to at least 2, 3, or even 4 dengue virus serotypes when such recombinant antigenic polypeptides are expressed in vivo. Such recombinant antigenic polypeptides of the invention, and such recombinant nucleotide sequences encoding recombinant antigenic polypeptides of the invention, are useful, e.g., in prophylactic/and or therapeutic methods of the invention for the induction, modulation, and/or enhancement of the production of neutralizing antibodies to at least 2, 3, or even 4 dengue virus serotypes when such recombinant antigenic polypeptides are expressed in vivo.

Example 10

This example illustrates the secretion characteristics of recombinant dengue antigens determined to induce, enhance, promote, and/or modulate neutralizing antibody production against dengue viruses of at least 2 serotypes in vivo.

The plasmid DNA corresponding to the pMaxVax10.1 vector comprising the recombinant nucleotide sequence of each of clones 18D7, 18E11, 16G11, 18H6, 18H2, 16B4, 14G10, 18E9, and 18E10 was isolated and purified by standard techniques and used to transfect 293 cells as described above and in Example 1 and 2. The transfected cells were cultured for 72 hours, and 15 μl of the unconcentrated cell-free medium supernatants subjected to polyacrylamide gel electrophoresis and membrane blotting. The nitrocellulose membranes were incubated with the anti-DEN-1, DEN-3, and DEN-4 antibodies from mouse ascitic fluid and appropriate enzyme-conjugated secondary antibodies to produce a Western blot using the techniques described above and in Example 1. FIG. 9 is a visualization of the Western blot obtained by this technique; the number (N) of wild-type dengue virus serotypes neutralized by the respective recombinant clones, as discussed in Example 9, is indicated on the bottom of the Western blot.

As shown in FIG. 9, 5 of the recombinant clones (18E9, 18E10, 18E11, 18H12, and 18H6) expressed and secreted recombinant antigens that produced dark bands on the Western blot, whereas three recombinant antigens (14G10, 16B4, 18D7) were well secreted, but not strongly bound by the antibodies, resulting in weaker bands. One recombinant clone (16G11) was not secreted at a detectable level in the unconcentrated supernatants. A comparison of the number of WT dengue virus serotypes neutralized by each recombinant antigen with its secretion profile indicated that there was no direct relationship between recombinant antigen secretion and the number of WT dengue virus serotypes neutralized by antibodies induced by the respective recombinant antigens. For example, the recombinant antigen that was not detectably secreted (16G11) produced neutralizing antibodies against all four WT dengue virus serotypes. The well-expressed and secreted recombinant antigens that produced dark bands (18E9, 18E10, 18E11, 18H12, and 18H6) produced neutralizing antibodies against two, two, four, four, and four WT dengue virus serotypes, respectively. The recombinant antigens that produced weaker bands (14G10, 16B4, 18D7) produced antibodies that neutralized two, four, and three 2 WT dengue virus serotypes, respectively.

The results of these experiments demonstrate that both secreted and cell membrane bound recombinant antigens of the invention (and the recombinant nucleotide sequences encoding such recombinant antigens) are effective in inducing, enhancing, promoting, and/or modulating production of neutralizing antibodies against one or more WT dengue virus serotypes in vivo.

Example 11

This example illustrates the longevity of the antibody response to recombinant dengue virus antigens induced by in vivo injection of DNA plasmids comprising recombinant nucleotide sequences of the invention that encode recombinant antigens of the invention.

An immune response against an infectious agent (e.g., protective immune response) preferably is one that is long-lasting. To test the longevity of the antibody immune response in a subject (e.g., mammal) receiving one or more injections of DNA plasmids encoding recombinant dengue antigens of the invention that induce neutralizing Ab responses against at least 2 dengue virus serotypes, the following experiments were performed.

Three mice each were injected with a pMaxVax10.1 DNA plasmid vector, wherein each such vector encoded a recombinant antigen corresponding to one of each of the following eight recombinant clones—16B4 (SEQ ID NO:89), 16G11 (SEQ ID NO:93), 18D7 (SEQ ID NO:105), 18E9 (SEQ ID NO:106), 18E10 (SEQ ID NO:107), 18E11 (SEQ ID NO:108), 18H2 (SEQ ID NO:109), or 18H6 (SEQ ID NO:110), at set time intervals. (Alternatively, mice each were injected with a pMaxVax10.1 DNA plasmid vector, wherein each such vector comprising a nucleic acid corresponding to one of each of the following eight recombinant clones 16B4 (SEQ ID NO:185), 16G11 (SEQ ID NO:187), 18D7 (SEQ ID NO:199), 18E9 (SEQ ID NO:170), 18E10 (SEQ ID NO:171), 18E11 (SEQ ID NO:172), 18H2 (SEQ ID NO:200), or 18H6

(SEQ ID NO:235). Antisera were obtained from these mice using techniques described above (e.g., Example 5). Sera collected from the mice at 55 and 120 days, respectively, after initial DNA immunization (day 0) by injection with these recombinant pMaxVax10.1 plasmid vectors were subjected to ELISA analyses, as described above, using, e.g., inactivated DEN-2 virus coated ELISA plates (all of these recombinant clones had previously been shown to induce a tetravalent antibody response in similar DNA plasmid injection experiments in vivo). The average OD values for antisera of mice injected with each type of plasmid were calculated at both test periods. The antibody response induced by each recombinant clone tested remained high at 55 days after the initial injection of the corresponding recombinant pMaxVax10.1 plasmid vector (comprising the recombinant nucleic acid encoding the recombinant antigen). Remarkably, the antibody responses induced by injection of these recombinant pMaxVax 10.1 vectors were substantially unchanged at 120 days after the initial pMaxVax10.1 vector injection as compared to 55 days after the initial pMaxVax10.1 vector injection. For example, antibody responses induced by injection of these recombinant vectors were increased or decreased within a range of from about 0.5%, about 1%, about 2%, about 5%, about 7%, about 10%, about 12%, or about 14%, at 120 days after the initial injection as compared to 55 days after the initial injection.

The results of these experiments demonstrate that recombinant antigens of the invention, and recombinant nucleic acids encoding such antigens, are capable of inducing and/or promoting an in vivo antibody response against multiple WT dengue virus serotypes over sustained periods of time, including e.g., over at least about 55 and 120 days.

Such antibody response(s) may be induced and/or promoted, e.g., by: (1) in vivo or ex vivo administration to a subject of a recombinant DNA plasmid vector comprising a nucleotide sequence that encodes a recombinant antigen of the invention (or a recombinant DNA plasmid vector comprising a recombinant nucleotide sequence of the invention) in an amount sufficient or effective to induce or promote such desired antibody response(s); or (2) by in vivo or ex vivo administration to a subject or cells of the subject of a recombinant antigen (or nucleic acid encoding such antigen) of the invention, or chimeric virus or VLP of the invention, in an amount effective to induce or promote such desired antibody response(s). Such antibody responses are also observed in in vitro or ex vivo assays using antisera obtained from such subjects. The desired Ab response may be, e.g., an antibody response that is sufficient for prophylactic and/or therapeutic treatment of a disease or disorder (including as, e.g., a prophylactic agent or vaccine against dengue infection or dengue fever). Administration of such recombinant DNA plasmid or recombinant antigenic polypeptide to a subject may be according to any in vivo or ex vivo method for delivery or administration of a nucleic acid or polypeptide (or pharmaceutical composition thereof) to a subject as described herein and throughout this specification, including, but not limited to, e.g., injection or gene gun delivery, and including dosages and/or compositions described herein, which may be dependent upon the particular application or treatment method of interest.

Example 12

This example illustrates the production of recombinant dengue virus antigens, and recombinant nucleic acids encoding recombinant dengue antigens, that induce the production of neutralizing antibodies against multiple dengue virus serotypes in vivo, wherein each such a recombinant dengue virus antigen comprises an amino acid sequence having a length (in amino acid residues) identical, substantially identical (e.g., having at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% identity in length), equivalent, or substantially equivalent to (e.g., at least about 95%, about 96%, about 97%, about 98%, about 99% or more identical in length to) the length of a fusion protein comprising or consisting of the full length amino acid sequence of a prM protein fused to the full length amino acid sequence of an envelope (E) protein of a dengue virus of a particular serotype. In another aspect, each such recombinant dengue virus antigen is encoded by a nucleotide sequence having a length equivalent or substantially equivalent to (e.g., at least about 95%, about 96%, about 97%, about 98%, about 99% or more identical in length to) the length of a nucleotide sequence encoding a fusion protein comprising or consisting of the full length prM protein sequence fused to the full length E protein sequence of a specific dengue virus serotype.

As described above, for selected methods of recursive sequence recombination, the following codon optimized dengue nucleotide sequences were used as parental sequences: Den-1 PRM15/tE CO, Den-2 PRM15/tE CO, Den-3 PRM15/tE CO, or Den-4 PRM15/tE CO. For each dengue virus serotype, each such parental nucleotide sequence comprised a codon optimized nucleotide sequence encoding a wild-type dengue fusion protein comprising: 1) a "PRM15 polypeptide" (e.g., a polypeptide sequence comprising an initial methionine (Met) residue and the last 15 amino acids of the C terminus of the prM protein of a WT dengue virus of a specific serotype, e.g., DEN-1); and 2) a truncated E protein, wherein the truncated E protein comprised from at least about 86%, 87%, 88%, 89%, 90%, 91%, 92%, 93%, 94%, or 95% or more of the contiguous amino acid residues of the full length E protein sequence of the same (WT) dengue virus serotype, as measured or beginning from about the N terminal amino acid residue of the E protein sequence. That is, the truncated E protein comprised a sequence of contiguous amino acid residues of at least about 86%, 87%, 88%, 89%, 90%, 91%, 92%, 93%, 94%, or 95% or more of the contiguous amino acid residues of the full length E protein sequence of the same (WT) dengue virus serotype, as measured from about the N terminal amino acid residue of the E protein sequence.

For each wild-type dengue virus of one of the four serotypes, a codon optimized nucleotide sequence encoding a fusion protein comprising the full length prM protein and full length E protein of that serotype were made. In one aspect, each such codon optimized nucleotide sequence was made via nucleotide extension of the truncated parental Den-1 PRM15/tE CO, Den-2 PRM15/tE CO, Den-3 PRM15/tE CO, or Den-4 PRM15/tE CO nucleotide sequence, respectively. To generate a nucleotide sequence encoding a fusion protein comprising a full length prM protein fused to a full length E protein (or, e.g., to generate a nucleotide sequence comprising a full length prM nucleotide sequence/full length E nucleotide sequence) via nucleotide extension for each of the codon optimized truncated parental nucleotide sequences (e.g., Den-1 PRM15/tE CO, Den-2 PRM15/tE CO, Den-3 PRM15/tE CO, and Den-4 PRM15/tE CO), codon optimized nucleotide sequences encoding the full length prM protein sequence and full length E protein sequence (i.e., the amino acid residues of the C terminus of E protein needed to be added to the corresponding truncated E protein of the particular dengue virus serotype to make a full length E protein) were determined for each dengue virus serotype (Den-1, Den-2, Den-3, and Den-4) in accordance with the methods described in Example 1. Each codon optimized truncated parental nucleotide sequence (e.g., Den-1 PRM15/tE CO, Den-2 PRM15/tE CO, Den-3 PRM15/tE CO, or Den-4 PRM15/tE CO nucleotide sequence) was analyzed for unique restriction site(s) at the 5' and 3' ends of the nucleic acid sequence of the E gene.

By performing such an analysis, it was determined that the codon optimized E genes for all 4 dengue virus serotypes included a unique BsrBI restriction site at about position 57 in the E gene for each particular virus. The BsrBI restriction site also was found in the respective recombinant dengue antigen-encoding nucleotide sequences of clones 5/21, 2/7, 2G11, and 6E12, facilitating 5' extension of these nucleotide sequences with additional nucleic acid residues necessary to make a corresponding full length (complete) prM gene sequence of a particular serotype, as further described below.

For each dengue virus of the 4 dengue virus serotypes, codon optimized nucleotide sequences also were generated for the full length prM gene and the nucleotide sequence encoding a 16-amino acid sequence comprising Met as the first amino acid residue and the (last) 15 amino acid residues from the C terminus of the capsid (C) gene of the particular dengue virus serotype. Such 16-amino acid sequence served as a signal sequence. Codon optimized prM genes of the dengue viruses of the 4 serotypes, including the nucleotide sequence encoding such 16 amino acid signal sequence, and the 5' sequences of the E gene overlapping the BsrB1 site, were synthesized by oligonucleotide assembly, as described in Example 1.

Sequence analysis also was able to identify unique restriction sites positioned near the 3' end of the various dengue E genes. Specifically, a unique BsaBI site was identified at position 1793 in the codon optimized DEN-1 prM/E gene sequence; a unique SexAI site was identified at position 1793 in the codon optimized DEN-2 prM/E gene sequence; a unique BglII site was identified at position 1863 in the codon optimized DEN-3 prM/E gene sequence; and a unique BsrGI site was identified at position 1884 in the codon optimized DEN-4 prM/E gene sequence.

For example, to extend the nucleic acid sequence of Den-4 PRM15/tE CO to a length equivalent or substantially equivalent to the length of a full length C15/full prM/full length E protein fusion protein, a human codon optimized nucleotide sequence corresponding to the 3' end of the DEN-4 E gene encoding the "C terminal extension" (e.g., a CO sequence comprising the nucleotide residues needed to be added to a truncated E gene to extend the truncated E gene to make a full length E gene) was also synthesized by standard nucleotide synthesis techniques. The synthesized codon optimized Den-4 C15/prM fragment (comprising a sequence of 16 amino acids—15 amino acids of the C terminal of the C protein and the first Met—and the additional N terminal nucleotide residues needed to extend the codon PRM15 nucleotide sequence of a particular serotype to make a full length CO C15/full prM nucleotide sequence) was digested with BsrBI, the synthesized 3' end of DEN-4 E gene (encoding such codon optimized C terminal extension nucleotide sequence) was digested with BsrG1, and the Den-4 PRM15/tE CO nucleotide sequence was digested with BsrBI and BsrG1 according to manufacturer's instructions. The three resulting fragments were ligated by standard techniques to extend the PRM15 and truncated E gene sequences to form a codon optimized Den-4 full length C15/full prM/full length E nucleotide sequence, designated "Den-4 C15/prM/E." The same methods were used to synthesize codon optimized C15 signal sequence/full length prM/full length E nucleotide sequences corresponding to each of Den-1, Den-2, and Den-3, respectively, using the specific unique restriction sites discussed above. The term "C15 signal sequence" typically refers to a 16 amino acid sequence that includes as the first codon a codon encoding a Met residue and subsequent codons that encode the 15 amino acids at the C terminus of the capsid protein of a dengue virus of one of the four serotypes. The resulting "full-length" codon optimized C15/full prM/full E nucleotide sequences code for each of the parental Den-1 C15/full prM/full E, Den-2 C15/full prM/full E, and Den-3 C15/full prM/full E polypeptides and were termed Den-1 C15/full prM/full E, Den-2 C15/full prM/full E, Den-3 C15/full prM/full E nucleotides, respectively. In this instance, the term "C15 signal sequence" refers to a 16 amino acid sequence that includes as the first codon a Met residue and subsequent codons that encode the 15 amino acids of the C terminus of the capsid protein, "prM" or "full prM" refers to a full length prM polypeptide or nucleic acid sequence, and the term "E" or "full E" refers to a full length E protein or nucleic acid sequence, depending upon context.

Using a parental Den-1 C15/full prM/full E codon optimized nucleotide sequence, digestions were performed with appropriate restriction enzymes (essentially as described above for the parental genes) to extend the nucleotide sequence of clone 2/7 (PRM15/tE format; SEQ ID NO:156) with a codon optimized nucleotide sequence encoding a 16 amino acid sequence comprising a Met residue as the first amino acid linked to the last 15 contiguous amino acids of the C terminal of the DEN-1 C protein, a portion of the N-terminal portion of DEN-1 prM protein, and codon optimized nucleotide sequence fragments encoding a portion of the C-terminus of DEN-1 E protein, sufficient to generate, upon appropriate ligation the 2/7 nucleotide sequence, a recombinant nucleotide sequence comprising a C15/full length prM/full length E format nucleic acid sequence, termed extended "2/7-D1" (SEQ ID NO:203). Recombinant "extended" codon optimized nucleotide acid 2/7 (SEQ ID NO:203) encoded recombinant 2/7-D1 (C15/full prM/full E format) polypeptide (SEQ ID NO:147).

The nucleic acid sequence of clone 5/21 (PRM15/tE format; SEQ ID NO:158) was similarly extended using nucleotide sequence fragments of the DEN-1 C protein, DEN-1 prM protein, and DEN-1 E protein to generate a recombinant extended codon optimized nucleotide sequence 5/21-D1 (extending clone 5/21 in PRM15/tEpolypeptide-encoding polynucleotide format to 5/21-D1 in C15/full prM/full E polypeptide-encoding polynucleotide format using wild-type Den-1 C terminal E protein fragment-encoding nucleic acid and wild-type Den-1 N terminal C15/truncated prM polypeptide-encoding nucleic acid for extension) (SEQ ID NO:201), which encoded recombinant 5/21-D1 (C15/full prM/full E format) polypeptide (SEQ ID NO:201).

Similarly, the parental DEN-4 C15/full prM/full E codon optimized nucleotide sequence was used to extend the nucleotide sequences of 2G11 (SEQ ID NO:157) and 6E12 (SEQ ID NO:159) to create "extended" 2G11-D4 and 6E12-D4 nucleotide sequences in C15/full length prM/full length E nucleotide sequence format (SEQ ID NOS:204 and 202, respectively), which encoded recombinant 2G11-D4 and 6E12-D4 (C15/prM/E format) polypeptides (SEQ ID NOS: 139 and 141, respectively). All such resulting recombinant nucleic acids in C15 nucleic acid/full length prM nucleic acid/full length E nucleic acid sequence format were amplified and cloned into pMaxVax10.1 vectors, as described above. The C15 nucleic acid/full length prM nucleic acid/full length E nucleic acid sequence format is conveniently referred to as the "C15/prM/E" or "C15/full prM/full E" format.

Mice were injected with pMaxVax10.1$_{6E12\text{-}D4}$ and pMax-Vax10.1$_{5/21\text{-}D1}$ plasmid vectors and the antiserum therefrom collected at 76 days after initial DNA plasmid vector injection, using the techniques described in Example 9. Non-extended clones pMaxVax10.1$_{6E12}$ and pMaxVax10.1$_{2G11}$ also were injected into mice under similar conditions. Antisera from these mice also were collected at 76 days after initial DNA plasmid vector injection. The antisera obtained from these mice were used in a plaque reduction neutralization titer assay as described in Example 9, and the inverse $PRNT_{50}$ titers from these assays were calculated and compared to the results of the experiments described in Example 9. The combined reciprocal $PRNT_{50}$ titers observed in the two sets of experiments are set forth in FIGS. 8A and 8B.

As shown in FIGS. 8A and 8B, both of the extended nucleotide sequences corresponding to "extended" clones 5/21-D1 and 6E12-D4 (C15/full prM/full E format) produced according to this technique encoded recombinant antigens that induced neutralizing antibodies against all 4 dengue serotypes in vivo, based on the PRNT assay standards (>20; dilution of serum (reciprocal)) provided in Example 9. In contrast to the nucleotide sequence of 6E12-D4 (C15 nucleic acid/full length prM nucleic acid/full length E nucleic acid format), which produced inverse (reciprocal) $PRNT_{50}$ titers of above 80 for each serotype, the nucleotide sequence of clone 6E12 (PRM15/truncated E gene format) produced reciprocal $PRNT_{50}$ titers of 35, >80, 70, and 20 for Den-1, Den-2, Den-3, and Den-4, respectively (i.e., except for Den-2, lower inverse $PRNT_{50}$ scores were observed for Den-1, Den-3, and Den-4 for clone 6E12 as compared to clone 6E12-D4). The nucleotide sequence corresponding to clone 2G11 also induced neutralizing antibodies against all 4 dengue virus serotypes.

These experiments demonstrate a method for producing recombinant dengue antigen-encoding nucleotide sequences, each of which encodes a fusion protein that is identical or substantially identical in length (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% identity in length) to a wild-type dengue virus "C15/full length prM protein/full length E protein" fusion protein. Such recombinant nucleotide sequences encode recombinant "C15/full length prM protein/full length E" fusion proteins. Plaque reduction neutralization assay analysis of such recombinant fusion protein demonstrated that extension of the polypeptide sequence of a recombinant PRM15/trunE dengue antigen with appropriate wild-type sequence fragments to produce an "extended" C15/full prM/full E dengue antigen may increase the number of dengue virus serotypes the antibodies induced by such extended recombinant antigens neutralize in vivo and the reciprocal PRNT titer of such neutralizing antibody responses relative to recombinant PRM15/truncE dengue antigens.

It was previously shown for tick-borne encephalitis (TBE), another flavivirus, that expression of the viral prM gene and 100% of the E gene of TBE can lead to viral polypeptide(s) forming a viral-like (empty) particle (VLP), which can have physical and antigenic characteristics that are substantially similar or identical to those of a whole virus. A VLP is not an infectious particle because it does typically not contain viral genetic material capable of producing live viruses.

The present invention also includes dengue viral-like particles (VLPs), each of which comprises a dengue polypeptide sequence of the invention, including, e.g., but not limited to: (1) a fusion protein comprising a recombinant C15 signal peptide/full length prM protein/full length E protein; (2) a fusion protein comprising a recombinant full length prM protein/full length E protein (with or without any signal sequence, including any flavivirus signal peptide, described herein); (3) a fusion protein comprising a recombinant full length M protein/full length E protein (with or without any pr segment or fragment of a pr segment, described herein) and (4) a recombinant full length E protein (with or without any signal sequence, including any prM or fragment thereof, described herein);

In the present case, recombinant VLPs of the invention can be made, e.g., as follows. Cells (e.g., 293 cells) are transfected with a plasmid vector comprising a recombinant nucleotide sequence encoding a recombinant protein or fusion protein of the invention (e.g., including any of those described in (1) to (4) above. The transfected DNA sequence is translated into the corresponding recombinant protein or fusion protein, respectively; in some instances, where a recombinant fusion protein is produced, such fusion protein which may be subsequently cleaved by a protease in the cell into its components, yielding, e.g., a full length prM protein and full length E protein; C15 signal peptide; M protein and E protein; and pr segment (typically degraded). One such expressed protein/peptide associates or assembles with at least one other such protein/peptide, forming oligomers and such oligomers assemble to form recombinant VLPs in the cells. The mature particles are released from the cells into the medium by exocytosis. In some embodiments, the resulting VLPs may further comprise, associate with, or assemble with cellular membrane material. In some instances, the signal peptide sequence is not included in the resulting recombinant VLP. Following expression and formation, the VLPs of the invention can be isolated by, e.g., gradient centrifugation or other methods known in the art. Such recombinant VLPs of the invention are useful in methods for the prophylactic and/or therapeutic treatment of diseases or disorders described herein or in diagnostic assays described herein for simultaneous detection or diagnosis of antibodies against two or more (e.g., two, three, four) serotypes of dengue virus in a sample, such as a biological sample from a subject, such as a human patient at risk for dengue virus infection.

Example 13

This example further demonstrates the improved expression and/or secretion of recombinant dengue virus antigens of the invention.

293 cell cultures were prepared and transfected with pMaxVax10.1$_{2G11}$, pMaxVax10.1$_{18H6}$, pMaxVax10.1$_{Den\text{-}3PRM15/tE\ CO}$, pMaxVax10.1$_{Den\text{-}4PRM15/tE\ CO}$, and pMaxVax10.1$_{null}$ plasmid vectors. The transfected cells were incubated for 72 hours under conditions permissive for transgene expression (or heterologous nucleotide expression) and secretion. A control vector that did not include a dengue virus nucleotide sequence (pMaxVax10.1$_{null}$ vector) was included for comparison. The cell-free medium from each such culture was obtained, subjected to standard polyacrylamide electrophoresis and membrane blotting, and the membrane incubated with a mix of anti-DEN-1, DEN-3, and DEN-4 antibodies from mouse ascitic fluid and appropriate enzyme-conjugated secondary antibodies in accordance with the techniques described in Example 1 to produce the Western blot. The lanes corresponding to recombinant 2G11 and 18H6 dengue antigens, expressed from pMaxVax10.1$_{2G11}$ and pMaxVax10.1$_{18H6}$, respectively, contained significantly more dengue E protein, as reflected in darker, broader bands, than was observed in the lanes corresponding to wild-type Den-3PRM15/tE and Den-4PRM15/tE dengue antigens, expressed from pMaxVax10.1$_{Den-3PRM15/tE\ CO}$ and pMaxVax10.1$_{Den-4PRM15/tE\ CO}$, respectively (data not shown). The results reflect higher levels of expression and/or secretion of recombinant 2G11 and 18H6 dengue antigens, expressed from pMaxVax10.$1_{12G11}$ and pMaxVax10.$1_{18H6}$, respectively. These results evidence the improved secretion and/or expression of recombinant dengue virus antigens of the invention.

Example 14

This example demonstrates the production of recombinant C15/full length prM/full length E CO dengue nucleotide sequences and recombinant fusion proteins encoded therefrom using recursive sequence recombination methods. Libraries comprising such recombinant nucleotide sequences were also generated.

Den-1PRM15/tE CO, Den-2 PRM15/tE CO, Den-3 PRM15/tE CO, and Den-4 PRM15/tE CO nucleotide sequences were extended using the techniques of Example 12 to generate Den-1 C15/full length prM/full E CO, Den-2 C15/prM/full length E CO, Den-3 C15/full length prM/full length E CO, and Den-4 C15/full length prM/full length E CO dengue nucleotide sequences, respectively. The plasmid DNA for each of these 4 extended antigen-encoding sequences was isolated from *E. coli* amplification, purified, and used as starting sequence material in recursive sequence recombination as described in Example 1. Recombinant nucleic acids were isolated by appropriate rescue primers and ligated into pMaxVax10.1 vectors. Library transfections of *E. coli* were performed as described in Example 2.

Example 15

This example demonstrates the ability of a recombinant dengue virus antigen of the invention comprising a recombinant fusion protein comprising a recombinant C15 signal peptide/full length prM protein/full length E protein, recombinant full length prM protein/full length E protein, or recombinant full length M/full length E protein to induce, enhance, or modulate production of antibodies that react with (or bind or specifically bind to) dengue viruses of multiple serotypes in vivo and/or ex vivo.

Libraries of recombinant nucleic acid sequences were generated by recursive sequence recombination using as parental sequences four human codon-optimized dengue virus nucleotide sequences encoding WT Den-1, Den-2, Den-3, and Den-4 polypeptides, respectively. Each such parental nucleotide sequence comprised the following: a nucleic acid encoding a methionine, a nucleotide sequence encoding the last 15 amino acid residues of the C terminal of the capsid (C) protein of the respective WT dengue virus (which served as a signal sequence), a nucleotide sequence encoding a full length prM sequence of the respective WT dengue virus, and a nucleotide sequence encoding the full length E protein of said respective WT dengue virus. Each such parent encoded a recombinant fusion protein comprising a Met residue at the N terminal, a recombinant amino acid sequence of 15 amino acid residues that served as a signal sequence, a recombinant full length prM protein, and a recombinant E protein.

Dot blot analyses of cell culture medium supernatants, wherein each supernatant obtained from 293 cells transfected with a particular pMaxVax10.1 vector comprising a specific shuffled nucleotide sequence obtained via shuffling of the C15/full prM/full envelope dengue virus parental human codon optimized nucleotide sequences, were performed. Analyses indicated the following recombinant C15/full prM/full E dengue antigen clones were expressed, secreted, and recognized by a mix of DEN-1, DEN-2, DEN-3, and DEN-4 mouse antibodies: 21C1 (SEQ ID NO:142), 23C12 (SEQ ID NO:143), 23D5 (SEQ ID NO:144), 23F5 (SEQ ID NO:145), 23G3 (SEQ ID NO:146), 23H7 (SEQ ID NO:148), 25B6 (SEQ ID NO:236), 25B10 (SEQ ID NO:237), 25D4 (SEQ ID NO:238), 25E11 (SEQ ID NO:239), 25H4 (SEQ ID NO:240), 27A11 (SEQ ID NO:241), 27G6 (SEQ ID NO:242), 28A11 (SEQ ID NO:243), 28C1 (SEQ ID NO:244), 28D11 (SEQ ID NO:245), 28E12 (SEQ ID NO:246), 28F9 (SEQ ID NO:247), 28H3 (SEQ ID NO:248), 28H9(SEQ ID NO:249). The pMaxVax10.1 DNA plasmid vectors comprising the shuffled C15/full length prM/full length E protein nucleotide sequences for clones 21C1, 23C12, 23D5, 23F5, 23G3, and 23H7 were isolated, purified, and injected into mice, along with pMaxVax10.$1_{null}$, following the DNA injection regimen described in Example 5. The experiments were performed in triplicate (i.e., three mice received repeated injections of each of the indicated plasmids). Sera from the mice were obtained at appropriate times (e.g., 28, 55, and 76 days after initial DNA injection (day 0)), and analyzed by ELISA, as described above, using DEN-1, DEN-2, DEN-3, and DEN-4 virus coated ELISA plates. Average OD values observed in the ELISA assays were calculated for each DNA vector tested. The results of these calculations are set forth for day 76 ("d76") antisera in FIG. 10.

FIG. 10 shows that all of these recombinant full length prM/full length E dengue antigens (Ag) (expressed with C15 signal peptide) induced production of populations of antibodies in vivo that reacted with all 4 DEN serotypes in vitro. OD values obtained in ELISA assays with pMaxVax10.$1_{23G3}$ and pMaxVax10.$1_{23H7}$ were the highest and similarly strong in all 4 assays with the 4 dengue virus serotypes. The signal peptide of the C15/full prM/full E dengue antigens is typically cleaved and thus similar or equivalent immune response and immune-stimulating results are believed produced with full prM/full E dengue antigen polypeptides.

The results of this experiment demonstrate that recombinant antigens of the invention comprising recombinant C15/full length prM/full length E protein sequences are capable of inducing, enhancing, and/or modulating the production of antibodies that react with (or bind or specifically bind to) one, two three, or 4 dengue virus serotypes in in vivo, ex vivo, and/or in vitro methods of the invention.

Example 16

This example demonstrates the secretion and/or expression characteristics of recombinant dengue antigens of the invention which comprise recombinant fusion proteins comprising, e.g., a recombinant C15 signal peptide/full length prM/full length E protein sequence, as determined by Western blot analysis. The invention also includes recombinant full length prM/full length E protein sequences and recombinant full length M/full length E protein sequences, which are produced by enzymatic cleavage of the C15 signal peptide from a C15 signal peptide/full length prM/full length E protein sequence and enzymatic cleavage of a "pr" segment from a full length prM/full length E protein sequence, respectively.

Individual 293 cell cultures were each transfected with a pMaxVax10.1 vector comprising a nucleotide sequence corresponding to one of the following eight representative recombinant clones: 23H7, 23G3, 23F5, 23D5, 23C12, 23A11, 21C1, and 21B4. The nucleic acid sequence of each such clone was generated and identified by the recursive sequence recombination (see, e.g., Example 15) and selected screening assays. Clones 23A1 and 21B4 were negative in an ELISA analysis performed by the techniques described in Examples 1 and 15. ELISA analysis indicated that the remaining six clones secreted and/or expressed recombinant antigens that induced production of antibodies that reacted with all four dengue virus serotypes in vivo (FIG. 10). After an appropriate incubation period under transgene expression-permissive conditions, the unconcentrated supernatant (cell-free portion of medium) from the transfected 293 cell cultures was collected, separated by polyacrylamide electrophoresis, and blotted onto an appropriate membrane for Western blot analysis as described in Example 1, using anti-DEN-1, DEN-3, and DEN-4 antibodies from mouse ascitic fluid. The nitrocellulose membrane bound proteins were incubated with antibodies from mouse ascitic fluid for DEN-1, DEN-3, and DEN-4. The recombinant antigens (produced by DNA shuffling and appropriate screening/selection procedures using C15/full length prM/full length E protein-encoding nucleotide sequence formats) that were positive for production of a multivalent antibody response in vivo (e.g., 23H7, 23G3, 23F5, 23D5, 23C12, 21C1) were associated with at least one visible band in the Western blot (data not shown), whereas the clones that did not induce such an antibody response (e.g., 23A11 and 21B4) were not associated with any significant bands in the Western blot, suggesting poor expression and/or secretion of proteins encoded by 23A11 and 21B4 clones as compared with the recombinant antigens 23H7, 23G3, 23F5, 23D5, 23C12, 21C1.

Additionally, bands corresponding to multimers (e.g., full length E protein dimers, trimers, and/or other multimers and/or misfolded protein complexes) were observed in the Western blot (data not shown). Since wild-type E protein is believed to form homodimeric rods on the surface of the virion (FIELDS VIROLOGY, supra), the appearance of bands corresponding to the size of E protein dimers by Western Blot indicates that the majority of the recombinant envelope proteins are correctly folding. Multimers of other polypeptides of the invention include, but are not limited to, e.g., C15/full length prM/full length E protein multimers; full length prM/full length E protein multimers; full length M/full length E protein multimers; PRM15/full length E protein multimers; PRM15/truncated E protein multimers).

The results of these experiments demonstrate that select nucleic acid sequences of the invention can be used to effectively express recombinant dengue antigens as secreted proteins.

Example 17

This example demonstrates the sequence diversity observed in various nucleic acids of the invention as compared to corresponding wild-type sequences.

The amino acid sequences of 16B4, 16G11, 18H2, 18H6, 18E11, 18E10, 18E9, 14G10, and 18D7, each of which comprised a PRM15/truncated E format, were determined and compared to the amino acid sequences of each of the WT parental polypeptides, DEN-1 PRM15/truncated E, DEN-2 PRM15/truncated E, DEN-3 PRM15/truncated E, and DEN-4 PRM15/truncated E. The results of these analyses are provided in FIG. 11. As shown in this figure, these recombinant PRM15/truncated E protein antigens of the invention exhibited complex sequence diversity, comprising multiple amino acid fragments or segments, each such fragment or segment comprising one or more amino acid residues of the four parental WT PRM15/tE protein dengue virus antigen sequences.

Recombinant polypeptide antigens corresponding to clones 23G3, 23H7, 23F5, 23C12, 23D5, 21C1, 21B4, 23A11, 5/21-D1, and 6E12-D4, each of which comprised a C15/full length prM/full length E protein format, were similarly sequenced and compared with respect to amino acid sequences of each of the DEN-1, DEN-2, DEN-3, and DEN-4 C15/full length prM/full length E fusion proteins. These antigens were similarly found to have complex sequence diversity, comprising multiple amino acid fragments or segments, each such fragment or segment comprising one or more amino acid residues of the four parental WT C15/full prM/full E protein dengue virus antigen sequences (data not shown).

Example 18

This example demonstrates, among other things, the ability of recombinant dengue virus antigens of the invention to induce or promote a protective immune response(s) in vivo in a subject, and administered ex vivo in tissue or cells of a subject, and/or in vitro in a population of cells. In this example, such immune response is induced or promoted upon expression of a recombinant dengue virus antigen of the invention from a plasmid vector comprising a nucleotide sequence encoding such antigen; the amount of plasmid vector administered is that sufficient to produce an immunogenic amount of the recombinant antigen. A protective immune response(s) can be similarly induced or promoted by in vivo, ex vivo, and/or in vitro administration to a subject of a an immunogenic amount of a polypeptide comprising such recombinant dengue virus antigen.

Dengue viruses do not typically induce clinical syndromes in adult mice. However, dengue viruses injected into the cerebellum of young mice (e.g., about 3-6 weeks old) cause paralyses, encephalitis and death. Such a mouse model can thus be used to evaluate the in vivo protective efficacy of sera produced in mice immunized with recombinant polypeptides of the invention or nucleic acids encoding such recombinant polypeptides.

Mice were immunized with 100 μg plasmid DNA of one of the following vectors: pMaxVax10.1$_{18H6}$, pMaxVax10.1$_{2G11\text{-}D4}$, pMaxVax10.1$_{6E12\text{-}D4}$, a mix of pMaxVax10.1$_{18H6}$/pMaxVax10.1$_{2G11\text{-}D4}$/pMaxVax10.1$_{6E12\text{-}D4}$, pMaxVax10.1$_{Den\text{-}2PRM15/tE}$ CO, pMaxVax10.1$_{Den\text{-}2}$ $_{C15/fullprM/full}$ $_{E}$, pMaxVax10.1$_{Den\text{-}3 C15/fullprM/full\ E\ P}$, a mix of four WT DEN-1-4$_{pRM15/tE\ CO}$, a mix of four WT DEN-1-4$_{C15/fullprM/full\ E}$, and, pMaxVax10.1$_{null}$ (termed "vector control" in FIG. 12); one group of mice was immunized with PBS buffer only. The nucleotide sequences corresponding to clones 18H6, 2G11-D4, and 6E12-D4 were SEQ ID NOS:235, 204, and 202, respectively; such sequences were generated using PRM15/tE (for 18H6) and C15/fullprM/full E (for 2G11-D4 and 6E12-D4) parental nucleotide sequences. Injections were repeated at day 10 after initial DNA injection. At 21 days after initial DNA injection, the mice were challenged with intracerebral injections of 100 LD$_{50}$ of DEN-2 virus particles. The injection and infection experiments were repeated in 5 different mice for each vector or control tested.

The mice were observed for 28 days after challenge for signs of paralyses, encephalitis and/or death. A graph of the survival rates in the first 28 days after challenge is provided in FIG. 12. The results reported in FIG. 12 demonstrate that the injection of a plasmid encoding either the 18H6 and WT DEN-2 polypeptide antigen (each in PRM15/tE format), or 6E12-D4 and WT DEN-2 (each in C15/full prM/full E format), as well a composition or mixture of the three recombinant antigens (18H6, 2G11-D4, and 6E12-4) in PBS was able to induce, enhance, or promote a protective immune response(s) against challenge with DEN-2 virus in vivo. At 28 days after DEN-2 virus challenge, all of the mice immunized with the above-listed recombinant clones were normal and thus protected. Mice immunized with either of the WT DEN-2 polypeptides (in either PRM/tE or C15/full prM/full E format) were also protected as observed 28 days after DEN-2 virus challenge. In contrast, of the mice injected with a tetravalent mix of the four WT DEN-1-4 antigens in the PRM/tE or C15/full prM/full E format only 50% were protected as observed 28 days after DEN-2 virus challenge. Of the mice injected with DEN-3 C15/full prM/full E antigen, only 50% were protected as observed 28 days after DEN-2 virus challenge. All of the PBS-immunized mice, and 75% of the mice that received injections of the vector control (pMV10.1 were dead 12 days after challenge with DEN-2 virus. The results of these experiments demonstrate that such recombinant polypeptide antigens of the invention (and nucleic acids encoding such recombinant antigens) are capable of inducing, promoting, and/or enhancing a protective immune response(s) against at least wild-type Den-2 virus in vivo. Analogous experiments can be performed using other animal models, if desired.

Analogous experiments are performed using mice (or other animal models) immunized with these recombinant antigens and challenged with Den-1, Den-3, and/or Den-4 viruses to assess the immune response(s) induced, promoted, or modulated by such recombinant antigens against one or more of these WT dengue viruses.

Similar experiments are performed using mice or other animal models immunized with other recombinant antigens of the invention, and/or nucleic acids encoding such antigens, and challenged with at least one of the four WT dengue virus serotypes.

Example 19

This example illustrates the preparation and use of recombinant antigens of the invention, including, e.g., tetravalent antigens, as diagnostic antigens or screening antigens (e.g., diagnostic tools) in methods to detect, diagnose, screen for, and/or identify the presence of antibodies against at least one, preferably two or more, and even more preferably, all 4 WT dengue virus serotypes in a sample, such as a biological sample from a mammal. Such recombinant antigens can be used for serum analyses either coated to a microtiter plate or spotted on a suitable membrane (nitrocellulose, nylon) for dot blot analysis or to a dip-stick membrane. Such microtiter plates or membranes, or dip-sticks can be coated with the recombinant antigens directly from the supernatant of transfected cells.

Four of the tetravalent antigens of the invention, corresponding to clones 2/7, 5/21, 2G11, and 6E12 as described in Example 5, each having a recombinant PRM15/tE protein format, were selected to test as diagnostic antigens. Recombinant C15/full prM/full E polypeptide antigens, which are believed to form VLPs, can also be used (e.g., 2/7-D1, 5/21-D1, 2G11-D4, and 6E12-D4). The feasibility of use of a recombinant antigen as a diagnostic antigen or diagnostic or screening tool in diagnostic or screening methods of the invention for the detection, diagnosis, screening or identification of the presence of antibodies against one or more of the 4 WT dengue virus serotypes in a sample was demonstrated by a dot blot assay. Specifically, human 293 cells were transfected with pMaxVax10.1 plasmids coding for each of the four selected tetravalent antigens. Three days after transfection, the media supernatants were harvested and spotted in serial dilution of 10-110 μl on nitrocellulose membranes. To evaluate the sensitivity of the assay, sera from mice (or sera from other mammals, such as humans) infected with dengue viruses were used in a 1:2000 dilution in PBS to detect or screen for type-specific antibodies. For detection or screening, the membranes were first incubated with the test sera and subsequently with secondary antibodies linked to a detection reagent (HRP (horseradish peroxidase), AP (alkaline phosphatase), or FITC (Fluorescein isothiocyanate)). The dot blot of the spotted media supernatants demonstrates that each of these recombinant polypeptide variants was well secreted (FIG. 13A) and recognized by all 4 type-specific anti-DEN antisera (FIG. 13B); thus, these clones can be used to detect or screen for serum antibodies against any of the 4 WT DEN serotypes. Moreover, as illustrated in FIGS. 13A and 13B, as little as about 10 μl of the crude supernatants from cell culture medium per dot in the assay was sufficient for detection of type-specific DEN antibodies in the sera, which makes manufacturing diagnostic dot blots using the recombinant dengue antigens (including, e.g., recombinant tetravalent dengue antigens) easy and inexpensive.

The results of these experiments demonstrate that even a very small amount of a recombinant dengue virus antigen of the invention (or composition thereof) provides a convenient substrate for analysis of biological samples obtained from subjects, e.g., mammals, including humans, for the presence or absence of anti-dengue virus antibodies against one or more virus serotypes. The present invention includes methods for detecting and/or screening for the presence of one or more type-specific antibodies in sera of dengue virus infected mammals, including humans. Such methods include those described above. In addition, the recombinant antigens of the invention (and nucleic acids encoding them) can be used in other diagnostic assays, such as, e.g., plate ELISA and dip stick assays, for detection of one or more type-specific antibodies in sera of dengue virus infected mammals.

The present invention also includes diagnostic dot blots comprising one or more of the recombinant dengue antigens of the inventions, and preferably including one or more of those recombinant dengue antigens of the invention that react (or bind or specifically bind to) antibodies of two or more, and preferably all four dengue virus serotypes. The invention further provides kits comprising one or more such diagnostic dot blots and/or one or more such diagnostic recombinant antigens.

Example 20

This example illustrates the dot blot analysis of a nucleotide library comprising recombinant C15/full length prM/full length E protein nucleotide sequences and selection from such libraries of those recombinant nucleotides expressing recombinant antigens (in recombinant C15/full length prM/full length E protein format or full length prM/full length E protein format) that exhibit improved secretion and/or expression in mammalian cells as compared to the secretion and/or expression WT prM/E antigens, respectively, in such mammalian cells.

Library transfections of *E. coli* and subsequent transfection of 293 cells in a 96 well cell culture format using plasmids comprising isolated clone DNA sequences encoding antigens in C15/full length prM/full length E protein format (or full length prM/full length E protein format) were carried out in accordance with the techniques described in Examples 2 and 14. Plasmids comprising a nucleotide sequence of the same format—C15/full length prM/full length E fusion protein-encoding nucleotide sequence (or a full length prM/full length E protein-encoding nucleotide sequence)—of one of each of the 4 WT dengue virus serotypes were used as controls in 293 cell transfections. The cell-free aspirated supernatant obtained from such 293 cell cultures after an appropriate period for recombinant antigen expression are then bound to membranes by application of standard dot blot techniques in accordance with applicable manufacturer instructions. The dot blot membranes are incubated with anti-DEN-1, DEN-2, DEN-3, and DEN-4 antibodies from mouse ascitic fluid and appropriate enzyme-conjugated secondary antibodies in accordance with the methods described in Example 1 for Western blots. Clones that indicate higher levels of secretion and/or expression than the control WT dengue C15/full prM/full E-encoding nucleic acids (WT dengue full prM/full E-encoding nucleic acids), as shown by the presence of a more intense signal on the dot blot, are then selected for further cloning and analysis.

This experiment demonstrates an exemplary strategy for analyzing a library of recombinant nucleic acids encoding recombinant dengue antigens, which have an amino acid sequence similar in size to a full length prM/full E fusion protein, for those antigens exhibiting improved or enhanced levels of secretion and/or expression in mammalian cells than corresponding WT dengue antigens of similar size.

Example 21

This example illustrates the production of recombinant dengue antigens each having an amino acid sequence identical in length to or substantially similar or substantially identical in length (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% identity in length) to a fusion protein comprising a C15 signal sequence, full length prM protein, and full length E protein.

The nucleotide sequences of clone 25B10 (SEQ ID NO:259) (in C15/full prM/full E protein format) and clone 16G11 (PRM15/tE format) (SEQ ID NO:187) were digested with appropriate restriction enzymes, and the nucleotide sequence of clone 16G11 was extended at its C terminus (C terminus of its truncated E protein) with a sufficient and appropriate codon optimized nucleotide segment of the C terminus of the E protein of 25B10 (see SEQ ID NO:259) and was extended at its N terminus (N terminus of its PRM15 signal peptide) with a sufficient and appropriate codon optimized nucleotide segment of the N terminus of the C15/full prM of 25B10 (see SEQ ID NO:259) to make a recombinant clone having a C15/full length prM/full length E format, as described in Example 12.

Similarly, the nucleotide sequences of recombinant clone 25B10 (SEQ ID NO: 259) (in C15/full prM/full E protein format) and recombinant clone 18H6 (PRM15/tE format) (SEQ ID NO:235) were digested with appropriate restriction enzymes, and the nucleotide sequence of clone 18H6 was extended at the C terminus of its truncated E protein with a sufficient and appropriate codon optimized nucleotide segment of the C terminus of the E protein of 25B10 (see SEQ ID NO:259) and was extended at the N terminus of its PRM15 with a sufficient and appropriate codon optimized nucleotide segment of the N terminus of the C15/full prM of 25B10 (observed in SEQ ID NO:259) to make a recombinant clone having a C15/full length prM/full length E format, as described in Example 12. Similarly, the nucleotide sequences of wild-type DEN-4 C15/full length prM/full length E protein (SEQ ID NO:234) and recombinant clones 16G11 (PRM15/tE format) (SEQ ID NO:187) and 18H6 (PRM15/tE format) (SEQ ID NO:235) were digested with appropriate restriction enzymes, and the nucleotide sequences of each of 16G11 and 18H6 were extended at the C terminus of the truncated E protein with sufficient and appropriate codon optimized nucleotide segment of the C terminus sequence of the E protein-encoding sequence of DEN-4 C15/full prM/full E protein-encoding nucleotide sequence (SEQ ID NO:234), and at the N terminus of the PRM15 with a sufficient and appropriate codon optimized nucleotide segment of the N terminus sequence of the C15/prM of DEN-4 C15/full prM/full E protein-encoding nucleotide sequence to make respective recombinant clones having C15/full length prM/full length E formats, as in Example 12. The resulting recombinant nucleic acids were named 16G11-25B10ext (SEQ ID NO:255) (i.e., 16G11 in PRM15/tE format extended to C15/full prM/full E format with appropriate nucleotide sequences of clone 25B10); 16G11-D4 (SEQ ID NO:254) (i.e., 16G11 in PRM15/tE format extended to C15/full prM/full E format with appropriate nucleotide sequences of WT Den-4); 18H6-25B10ext (SEQ ID NO:257) (i.e., 18H6 in PRM15/tE format extended to C15/full prM/full E format with appropriate sequences of clone 25B10); and 18H6-D4 (SEQ ID NO:256) (i.e., 18H6 in PRM15/tE format extended to C15/full prM/full E format with appropriate sequences of WT Den-4). These extended nucleic acid sequences were amplified and cloned into pMaxVax10.1 vectors, as described above. The corresponding recombinant polypeptide sequences for 16G11-25B10ext, 16G11-D4, 18H6-25B10ext, and 18H6-D4 are SEQ ID NOS:255, 254, 257, and 256, respectively. These amplified plasmids were analyzed in vivo by injection of mice and subsequent ELISA assays essentially as described in Example 15. The recombinant antigens of clones 25B10, 16G11-25B10ext, 16G11-D4, 18H6-25B10ext, and 18H6-D4 all induced antibodies in mice that strongly cross-reacted with all 4 dengue virus sero-types in ELISA assays (data not shown).

Example 22

This example illustrates the use of ELISpot assay (Enzyme-Linked ImmunoSPOT) to measure the number of T lymphocytes (T cells) secreting interferon gamma, as a marker of the T cell activating effects of polypeptides of the invention.

Subjects selected from an appropriate mammalian model for testing dengue virus vaccines (including, e.g., but not limited to, inbred mice, monkeys, or chimpanzees) or human patients (e.g., in a phase I clinical trial) are injected with a particular pMaxVax10.1 DNA plasmid vector (about 0.5-2 mg DNA plasmid vector in about 0.5-1 ml of an endotoxin-free carrier (e.g., PBS or another suitable saline buffer, 0.1M NaCl, or any suitable carrier which maintains the pH of the solution at about 7.4) injection volume for, e.g., humans or monkeys; plasmid amounts/compositions similar to those used in the above-described experiments for in vivo mice experiments are suitable for mice), wherein each vector comprises a particular recombinant antigen-encoding nucleotide sequence of the invention. For example, each subject is injected with a pMaxVax10.1 DNA plasmid vector that comprises one of the following: 1) a recombinant nucleotide sequence that encodes a PRM15/tE fusion protein (e.g., nucleotide sequences having SEQ ID NOS:157 (2G11), 158 (5/21), 159 (6E12), 185 (16B4), 187 (16G11), 172 (18E11), 200 (18H2), 235 (18H6)); 2) a recombinant nucleotide sequence that encodes a C15 signal peptide/full length prM protein/tE fusion protein (e.g., nucleotide sequences having SEQ ID NOS:254 (clone 16G11-D4), 255 (clone 16G11-25B10ext), 256 (clone 18H6-D4), 257 (clone 18H6-25B10ext)) (see, e.g., methods described in Examples 1 and 12); or another recombinant nucleotide sequence of the invention. Optionally, but preferably, initial DNA plasmid administration is followed by boosting with an immunogenic amount of the recombinant polypeptide encoded by the same nucleic acid included in the plasmid vector (delivered initially) or by re-administration of the same pMaxVax10.1 vector at about 14-28 days after initial DNA plasmid injection. Preferably, a second (polypeptide) protein boost (using the same recombinant polypeptide) and/or DNA plasmid vector boost (using the same plasmid vector that encodes the same recombinant polypeptide) is performed between 2-6 months after the initial infection. One group of control subjects receives no injection. Another group of control subjects receives injections of pMaxVax $10.1_{null}$. Experiments are preferably performed with multiple subjects for each plasmid construct tested.

Sera are collected from the subjects at appropriate test times (e.g., about 60 days, 120 days, or 180 days after initial DNA plasmid injection, preferably including a time falling at least 2-4 weeks after the last recombinant polypeptide antigen/DNA vector boost) and T cells isolated by methods known in the art. For example, in human patients in a clinical study, peripheral blood mononuclear cells (PBMC) can be isolated from human blood by centrifugation over Histopaque-1077 (Sigma, St. Louis, Mo.) (using Ficoll gradient separation). T cells are isolated and purified either by staining the cells with anti-human CD2 monoclonal antibodies (mAbs) and sorting for CD2 positive ($CD2^+$) cells using a FACS Vantage SE or removing cells that stained with mAbs specific for CD 14, CD20, CD56 and CD94 by magnetic beads (e.g., Dynabeads, Dynal, Lake Success, N.Y.) following the manufacturer's instructions. Antibodies useful in such techniques can be purchased from Pharmigen (San Diego, Calif.). Magnetic separation of the T cells using Dynal Dynabeads is performed by first labeling PBMCs with pure monoclonal antibodies against CD14, CD20, CD56 and CD94, then labeling the cells with Sheep anti-mouse Dynabeads according to manufacturer's instructions. Non-T cells are removed by depleting with a magnet. The purity of the T cells should be 96-99% when analyzed by staining with anti-CD3 mAbs purchased from Pharmigen (San Diego, Calif.).

A 96 well ELISpot plate is coated with antibody (immunoglobulin (Ig)) that is specific for IFN-gamma. For example, NIB42 capture antibody (Pharmigen) can be used for plate coating. Other capture antibodies that can be used are known in the art. The antibody (Ig) binds to the nitrocellulose base of the ELISpot plate.

The activated T cells are transferred to the ELISpot plate, and IFN-gamma is released during the incubation period. IFN-gamma released locally around T cells is bound, and therefore is "captured" by the IFN-gamma specific antibody. The cells and any excess cytokines are washed off. A second antibody that is also specific for IFN-gamma is added. This antibody is coupled to an enzyme that is capable of converting a substrate into an insoluble colored product. For example, 4S.B3 biotinylated detection antibody (Pharmigen) can be used to quantify IFN-gamma production. Other detection antibodies that can be used are known in the art. The plates are washed once more, and the enzyme substrate is added. The substrate is converted into the insoluble product, forming spots of color that represent the areas of captured cytokines that were secreted by adjacent T cells. The colored spots are counted using a microscope or digital-imaging system such as an ELISpot reader (such as the ELISpot reader sold by Scanalytics, Inc.) by following manufacturer's instructions.

T cells obtained from sera of subjects that have been injected with a pMaxVax10.1 vector comprising a recombinant nucleic acid sequence of the invention exhibit a significantly higher level of IFN-gamma expression than T cells obtained from the sera of subjected injected with pMaxVax$10.1_{null}$ or receiving no DNA injection.

This example illustrates the use of ELISpot to quantify the number of circulating antigen-specific CD8+ T cells. This example also demonstrates the antigen-specific increase in T cell activity associated with administering a DNA sequence encoding a recombinant polypeptide of the invention to a subject host, e.g., mammal.

Example 23

This example demonstrates ELISPot analysis of T cell associated IFN-gamma expression induced or modulated by recombinant polypeptides of the invention.

PBMCs are isolated from a mammal model or human and stimulated with one or more recombinant antigens of the invention, such as, e.g., but not limited to, SEQ ID NOS:66 (clone 2G11), 67 (5/21), 69 (6E12), 89 (16B4), 93 (clone 16G11), 108 (18E11), 109 (18H2), 110 (18H6), all of which are of the PRM15/tE format, or SEQ ID NOS:254 (clone 16G11-D4), 256 (16G11-25B10ext), 257 (18H6-D4), and/or 258 (18H6-25B10ext), all of which are of the C15/full prM/full E format, for about 6-24 hours and then mixed with enzymatically-tagged cytokine antibodies. The mixture is then chemically treated so that bound antibody-cell complexes (i.e., cytokine-secreting cells) are stained blue.

A suitable IFN-gamma ELISpot assay that can be used for quantitative IFN-gamma ELISPot analysis is commercially available through Biosource International, Camarrillo, Calif. The assay is performed according to the manufacturer's instructions and using standard techniques. For example, enumeration of IFN-gamma secreting cells in single cell suspension is performed by adding 50 µl of diluted coating antibody to each well followed by the addition of 50 µl of PBS. Each well is incubated overnight at 4° C. Samples are then aspirated and washed 5 to 10 times with wash buffer. 200 µl of post-coating solution is added into each well and wells are incubated 1 hour at 37° C. or overnight at 4° C. The wells are aspirated and not washed. Wells are 100 µl of pre-stimulated single cell preparation are added into the wells. The plate is covered with the plate cover and incubated for 5 hours at 37° C. in a humidified atmosphere containing 7% $CO_2$. The wells are aspirated, 200 µl ice-cold deionized water is added, and the plate is placed for 10 min on melting ice. The wells are washed 10 times with PBS. 100 µl of diluted biotinylated Antibody solution is added, the plate is covered and incubated for 1 hour at 37° C. or overnight at 4° C. The wells are aspirated and washed 5 to 10 times with PBS. 50 µl of diluted—labeled anti-biotin antibody solution (GABA) is added to each well. The plate is covered and incubated 1 hour at 37° C. The wells are aspirated and washed 5 to 10 times. 30 µl of activator solution is added to each well. The spot development is followed by light microscopy. When clear spots have developed, the reactions are stopped by rinsing the wells with distilled water. The results using recombinant clones in the PRM15/tE fusion protein format and C15/full length prM/full length E fusion protein format are compared with results obtained with subjects immunized with wild type dengue PRM15/tE fusion proteins and C15/full length prM/full length E fusion proteins. Results are also compared with subjects that were not immunized with any dengue antigen.

The results of such ELISpot analysis indicate that recombinant polypeptides of the invention are able to induce and/or modulate IFN-gamma expression from T cells. The present invention also provides alternative techniques for conducting ELISpot assays with recombinant polypeptides and/or polynucleotides of the invention.

Example 24

This example demonstrates a T-cell proliferation assay to measure the proliferation of a patient's T cells in response to stimulation with recombinant polypeptide antigens of the present invention.

T cells in a suitable subject (preferably a human patient) are stimulated with pMaxVax10.1 vectors as described in Example 22, followed by removal of a whole blood-based sample and separation of specific T-cell subsets. Monoclonal antibodies attached to paramagnetic particles recognize specific cell surface markers, and T cells are isolated when the sample is placed in a magnetic field. Several signs of T cell activation can be measured by such a technique. For example, increased intracellular ATP accumulation is associated with T-cell activation, so a luminescent ATP assay employing firefly luciferase can be used to measure the level of activation among isolated cells (an example of a commercially suitable assay in this respect is the Luminetics Assay, available through Cylex).

Additionally or alternatively, T cell proliferation is measured by $^3$H-thymidine incorporation. Briefly, 293 cells (or COS-7 cells or other cells of interest) are transfected with a pMaxVax10.1 plasmid vector encoding a recombinant dengue antigen of the invention, e.g., a recombinant tetravalent dengue polypeptide antigen (as described, e.g., in Example 22) or a control plasmid vector lacking an insert (e.g., pMaxVax10.1$_{null}$ vector). The Effectine HTP (Qiagen, Valencia, Calif.) 96-well transfection method is used for plasmid transfections according to manufacturer's instructions.

Twenty-four hours after transfection, approximately 5×10$^4$ purified T cells (purified as described, e.g., in Example 21) are cultured in triplicate in the presence of irradiated (5000 radians (rads)) transfectants and soluble anti-human CD3 mAbs (5 µg/mL) in a 96-well plate culture format (e.g., the system commercially available through VWR, Westchester, Pa.) at 37° C. in a humidified atmosphere containing 5% $CO_2$ in Yssel's medium supplemented with 10% FCS (200 µl/well) for a total of 3 days (72 hours). 1 microCurie (µCi)/well of $^3$H-thymidine (Amersham, Piscataway, N.J.) is added by pulsing to the cell cultures during the last 8 hours of the culture period, and the cells are harvested for counting onto filter paper by a cell harvester (Tomtec, Hamden, Conn.). $^3$H-thymidine uptake/incorporation in the cultured cells is determined by measuring the radioactivity on the dried filters using a MicroBeta scintillation counter (Wallac, Turku, Finland) according to the manufacturer's instructions. Proliferation of T cells is expressed as the mean counts per minute (cpm) of triplicate wells.

At least some of the recombinant polypeptide antigen-encoding plasmids of the invention (e.g., recombinant tetravalent polypeptide antigen-encoding plasmids of the invention) induce T cell responses and/or T cell proliferation at levels significantly higher than those seen in a plasmid control and/or at least as high a level as observed with plasmids encoding a WT dengue virus fusion protein having about the same length or substantially similar or substantially identical length (e.g., at least about 75%, 80%, 85%, 86%, 87%, 88% or 89%, preferably at least about 90%, 91%, 92%, 93%, or 94%, and more preferably at least about 95% (e.g., about 87-95%), 96% 97%, 98%, 99%, 99.5% identity in length) as (e.g., if the plasmid encodes a recombinant polypeptide antigen comprising a PRM15/tE fusion protein, a plasmid encoding a WT dengue polypeptide comprising a DEN 1, 2, 3, or 4 PRM15/tE fusion protein is used for comparison; if the plasmid encodes a recombinant polypeptide antigen comprising a C15/full length prM/full length E fusion protein, a plasmid encoding a WT dengue polypeptide comprising a DEN 1, 2, 3, or 4 C15/full length prM/full length E fusion protein is used for comparison). Plasmid vectors encoding a recombinant PRM15/tE-encoding sequence or recombinant C15/full length prM/full length E-encoding sequence that induce or promote T cell proliferation and/or activation at a level significantly above that induced or promoted by the plasmid vector control (or other control), and preferably at a level at least about similar or equivalent to that induced or promoted by a pMaxVax10.1 vector comprising a wild-type dengue virus PRM15/tE-encoding sequence or C15/full length prM/full length E-encoding sequence, respectively, can be identified and selected or isolated for further characterization (e.g., sequencing, effects in other T cell activity assays, and/or diversity analysis).

This experiment demonstrates assays suitable for assessing T-cell proliferation effects of recombinant polypeptide antigens of the invention. This experiment also demonstrates that at least some recombinant antigens of the invention induce or promote T cell proliferation and/or T cell activation effects in mammalian cells.

Example 25

This example illustrates the use of a cytotoxicity assay to quantify the amount of T cells expressing a recombinant dengue virus antigen of the invention in a particular sample.

Populations of 293 cells are transfected with a pMaxVax10.1 plasmid vector encoding a recombinant polypeptide antigen of the invention, with a pMaxVax10.1$_{null}$ plasmid vector (control), or with nothing as described in Examples 22. The transfected cells are labeled with a radioactive isotope of chromium ($^{51}$Cr). A subject's T cells (e.g., human T cells) that have been isolated and purified as described in Example 21 are obtained, mixed with the target cells, and the mixture is incubated for several hours. Lysis of antigen-expressing cells releases $^{51}$Cr into the medium. Recombinant antigen-specific lysis is calculated by comparing lysis of 293 cells expressing a recombinant antigen of the invention or control antigen in the presence or absence of the subject's effector cells. The results of such experiments are expressed as a percentage of cells exhibiting recombinant antigen-specific lysis. The percentage of cells exhibiting recombinant antigen-specific lysis in such experiments demonstrates the recombinant antigens of the invention are capable of inducing a significant cytotoxic immune response in a subject. This example provides a method of measuring the amount (number) of T cells expressing recombinant dengue virus specific antigens.

Example 26

This example illustrates the use of a tetramer assay to measure the amount (number) of CD8+ T-cells that recognize (and/or bind or selectively bind) a specific epitope in a recombinant polypeptide of the invention.

Putative MHC class I binding sequences occurring in recombinant polypeptides of the invention are identified by sequence analysis using a suitable epitope-identification algorithm or program, such as the BONSAI algorithm developed at Stanford University, the TEPITOPE algorithm, the SYFPEITHI program (which applies the algorithm of Rammensee et al.), the MAPPP program (available at http://www.mpiib-berlin.mpg.de/MAPPP/), the PREDEP program (available at http://bioinfo.md.huji.ac.il/marg/Teppred/mhc-bind/), the ProPred program (http://www.imtech.res.in/raghavalpropred), and the BIMAS program (available at http://bimas.dcrt.nih.gov/molbio) which are variously described in, e.g., Altuvia et al., *Mol. Immunol.*, 31, 1-19 (1994), Brusic et al., *Nuc Acids Res.*, 22, 3663-3665 (1994), Hammer et al., *J. Exp. Med.*, 180, 2353-2358 (1994), Parker et al., *J. Immunol.*, 152, 163-175 (1994), Sturniolo et al. *Adv. Immunol.*, 66, 67-100 (1997), and Cunha-Neto, *Braz. J. Med. Biol. Res.*, 32(2), 199-205 (1999), or other suitable software to analyze the amino acid sequence of recombinant polypeptides of the invention. The amino acid sequences of test polypeptides also can be subjected to sequence analysis identify predicted T cell epitopes using software programs such as EpiPlot 1.0 (available at http://genomics.com/software/files/epiplot1.exe), the EPIMER/EPIMAX algorithm developed at the Brown University School of Medicine (currently managed by EpiVax, Inc. (Providence, R.I.), or a sequence analysis algorithm such as the SOHHA algorithm (described in Reyes et al., *Methods Enzymol* 202:225-38 (1991)). In addition, information and software programs for identifying and/or predicting T cell epitopes using software programs in polypeptide sequences of the invention can be obtained at the following websites: http://www.epitope-informatics.com, http://www.vaccinome.com/index.htm, http://syfpeithi.bmi-heidelberg.com/scripts/MHCServer.dll/home.htm, http://www.imtech.res.in/raghava/propred/index.html, http://bimas.dcrt.nih.gov/molbio/hla_bind/http://epivax.com/epitope.html, and http://www.tepitope.com.

Related techniques for identifying T cell and B cell epitopes are described in, e.g., International Patent Application WO 99/53058, Kammerer et al., *Clin Exp Allergy* 27:1015-1026 (1997), Sakakibara et al. *J Vet Med Sci* 60:599-605 (1998), Jiang et al., *Protein Sci* 9:403-416 (2000), Milik et al., *Nat Biotech* 16(8):753-756 (1998), Walshet et al., *J Immunol Meth*, 121:1275 (1989), and Schoofs et al. *J Immunol* 140:611-616 (1987).

T cells are isolated and purified as described in Example 22. The T cells are mixed with a polypeptide comprising a single predicted MHC I binding sequence or T cell epitope identified by, e.g., one of the above-described methods/analyses, joined to a class I HLA molecule (a molecule on the surface of CD8+ cells that helps display the epitope to the immune system)—more particularly, a synthetic tetrameric form of a fluorescently labeled MHC Class I molecule. As CD8+ T cells recognize antigen in the form of short peptides bound to MHC class I molecules, T cells with the appropriate T cell receptor bind to the labeled tetramers and can be quantified by flow cytometry as described in Example 2. T cells with receptors for a specific epitope without prior antigen stimulation are quantified. The results of such experiments are highly quantitative and sensitive.

At least some of the recombinant polypeptides contain epitopes that react with (or bind or specifically bind to) T cells in the above-described assay. The results of these experiments confirm the cytotoxic effects attendant at least some of the recombinant polypeptides of the invention.

This experiment provides a suitable assay for quantifying CD8+ T cells that react with (or bind or specifically bind to) a polypeptide of the invention. This experiment also provides a technique for identifying novel T cell epitopes in such polypeptides.

Example 27

This example illustrates a method of immunization of rhesus macaque monkeys with an effective amount of an immunogen-encoding or antigen-encoding nucleotide sequence of the invention sufficient to induce a protective immune response(s) in the monkeys against one or more (and preferably against two or more) dengue virus serotypes. Such an amount may be an immunogenic amount or an antigenic amount. DNA-based immunization methodologies using wild-type dengue virus antigens and rhesus macaque monkeys have been described (see, e.g., the methods described in Raviprakash et al., *J. Gen. Virology* 81:1659-1667 (2000), which is incorporated herein by reference in its entirety for all purposes), and such methods can alternatively be employed herein or adapted as desired.

RNA or DNA sequences of the invention can be used in the methods described below. In the studies below, an immunogen- or antigen-encoding DNA sequence is employed for each study. Each study is conducted according to the guidelines in "Guide for the Care and Use of Laboratory Animals, Institute of Laboratory Animal Resources," National Research Council, DHHS Publication,No. NIH-86-23 (1985). Animals are obtained from the Walter Reed Army Institute of Research animal facility in Forest Glen, Md.

Rhesus macaque monkeys (*Macaca mulatta*), aged approximately 7 to 24 years, are pre-tested for the presence of antibodies against dengue viruses of each of the four dengue virus serotypes by ELISA assay and plaque-reduction neutralization test. Those monkeys that do not show evidence of exposure to such dengue viruses (e.g., are sero-negative for such dengue viruses) are divided into several groups of three monkeys/group. Each monkey in a non-control group is inoculated intramuscularly (i.m.) or intradermally (i.d.) with a composition comprising an immunogenic amount or antigenic amount (e.g., about 0.1 µg to about 5 mg) of pMax-Vax10.1 DNA plasmid vector comprising a nucleic acid sequence of the invention (as described in Example 22) in a carrier, such as, e.g., an endotoxin-free carrier, such as, e.g., a pharmaceutical carrier (e.g., PBS or another suitable saline buffer, 0.1M NaCl, or any suitable carrier which maintains the pH of the solution at about 7.4); the carrier optionally comprises additional excipients such as preservative agents. Alternatively, another plasmid vector comprising such nucleotide sequence of the invention can be used. Each monkey of a particular group is immunized with the same vector in the same concentration in the same manner.

In one study, a pMaxVax10.1 vector comprising a nucleic acid sequence encoding a recombinant PRM15/tE dengue virus antigen fusion protein is tested. In such study, e.g., each monkey in a group is administered with a pMaxVax10.1 vector comprising a nucleic acid sequence comprising a recombinant PRM15 gene and recombinant truncated envelope (E) gene. Such nucleic sequence comprises, e.g., one of the following: SEQ ID NOS:157 (clone 2G11), 158 (clone 5/21), 159 (clone 6E12), 185 (clone 16B4), 187 (clone 16G11), 200 (clone 18H2), 172 (clone 18E11), and 235 (clone 18H6).

In a second study, a pMaxVax 10.1 vector comprises a nucleic acid sequence encoding a recombinant C15/full length prM/full length E dengue virus antigen fusion protein. In such study, e.g., each monkey in a group is administered with a vector comprising a recombinant C15 gene, recombinant full length prM gene and recombinant full length E gene. Such nucleic sequence comprises, e.g., one of the following:

SEQ ID NOS:254 (clone 16G11-D4), 255 (clone 16G11-25B10ext), 256 (clone 18H6-D4), and 257 (clone 18H6-25B10ext).

As a control, each monkey of a control group of three monkeys is mock immunized with the carrier alone (with no plasmid vector). As a second control, each monkey of another group of three test monkeys is immunized with the same amount of pMaxVax10.1$_{null}$ plasmid vector control (null vector) (e.g., for i.m. or i.d. injection, 1 mg of pMaxVax10.1$_{null}$ plasmid vector is administered in the same total volume, in one injection or divided in several injections, as in administration of recombinant vectors).

While intramuscular and intradermal injection administrations are among the preferred routes of administration, vectors comprising the immunogen-encoding or antigen-encoding DNA or RNA sequences of the invention (and vector compositions thereof) can be administered by a variety of standard routes of administration as described herein, vector compositions can be any of those described herein, including, e.g., but not limited to, needle injection, parenteral administration, subcutaneous administration, gene gun or other biolistic delivery device, impression through the skin, oral delivery, inhalation, topical or transdermal delivery (e.g., using a transdermal patch or ointment).

The total amount of recombinant plasmid vector administered depends upon the manner of administration. For administration via needle injection, about 0.3 mg to about 2 mg, usually about 1 mg, of such DNA plasmid vector is typically administered. For administration via gene gun, about 0.1 μg to about 100 μg plasmid vector, typically from about 1 μg to about 10 μg plasmid vector, are administered.

The total volume of the plasmid vector composition for each immunization typically depends upon the amount or dose of DNA vector (in mg) to be administered. For 1 mg DNA vector administered via injection, the total volume is typically about 0.5 ml. The total volume of the vector composition can be administered in one administration or divided into several smaller volumes administered in several administrations consecutively, sequentially, or simultaneously, at one or more sites in the animal.

For example, for intramuscular administration, 0.5 ml total volume of DNA plasmid vector composition is typically administered to a monkey in one injection or two injections in a muscle of the monkey, such as, e.g., the tibialis anterior muscle. For intradermal administration, e.g., 0.5 ml total volume of DNA plasmid vector composition is typically administered to a monkey (e.g., anterior thoracic dermal area of monkey) in five administrations of 0.1 ml each. One of skill in the art can employ and/or adapt other administration formats, volumes, and compositions known in the art.

The DNA plasmid vector is optionally administered with one or more transfection promoting agents (including, e.g., those described herein), one or more immunostimulatory sequences (including, e.g., nucleotide sequences comprising CpG islands or unmethylated CpG motifs, termed ISS motifs) (see Krieg, *Trends in Microbiol* 7:64-65 (1999)), one or more cytokines (e.g., GM-CSF), one or more adjuvants (e.g., LAMP, alum, other known adjuvants), and/or one or more costimulatory molecule-encoding sequences. Such costimulatory molecule-encoding sequences may include, but are not limited to, e.g., at least one mammalian B7-1-encoding nucleotide sequence or B7-1 homolog-encoding nucleotide sequence, at least one mammalian B7-2-encoding nucleotide sequence or B7-2 homolog-encoding nucleotide sequence, or at least one novel co-stimulatory polypeptide-encoding nucleotide sequence described in International Patent Application WO 02/00717, filed Jun. 22, 2001 (including e.g., at least nucleotide sequence encoding, e.g., a CD28 binding protein ("CD28BP"), such as CD28BP-15), or any combination thereof. Adjuvants can be delivered to a subject with one or more recombinant dengue polypeptides of the invention. In one format, a DNA vector comprising a sequence that encodes a recombinant antigen polypeptide and an intracellular targeting adjuvant (e.g., LAMP protein sequence) and/or lysosomal associated membrane protein can be used for delivery to a subject.

The immunizations (e.g., vaccinations) are repeated at least twice after the initial inoculation with the identical vector composition in the same concentration (e.g., 1 mg vector/0.5 ml total volume). Each subsequent inoculation or immunization is often termed a "boost." The second inoculation (i.e., first "boost") is administered two weeks or one month after initial inoculation. The third inoculation (i.e., second "boost") is typically administered at about 2 to about 6 months following the initial inoculation (most typically at about 4, about 5, or about 6 months after the initial inoculation). Those monkeys receiving intradermal inoculation(s) can be inoculated a fourth time with the same vector in the same amount at 12, 14 or 18 months after the initial inoculation. Groups of control animals are administered with an "empty" plasmid vector (e.g., pMaxVax10.1$_{null}$) in the same concentration (e.g., 1 mg/0.5 ml) or a carrier (e.g., pharmaceutical carrier) in the same volume (e.g., 0.5 ml) alone during the first (initial), second, third, and fourth inoculations.

Alternatively, for another group(s) of monkeys, one or more recombinant polypeptides of the invention can be used for the inoculation or immunization boosts following the initial inoculation as described in Example 28. The effectiveness of one or more boosts using a polypeptide antigen of the invention versus an immunogen-encoding or antigen-encoding DNA or RNA sequence of the invention is compared. Such polypeptide antigens can be administered by a variety of standard routes of administration as described herein, including, e.g., parenteral, intramuscular and intradermal delivery (see Example 28).

While intramuscular and intradermal injection administrations are among the preferred routes of administration, vectors comprising the immunogen-encoding or antigen-encoding DNA or RNA sequences of the invention can also be administered by a variety of standard routes of administration as described herein, including, e.g., parenteral administration, subcutaneous administration, or by biolistic injection (e.g., a gene gun).

Sera are obtained from each monkey (e.g., by bleeding each monkey daily for 5 to 10 days). The sera are tested for the presence of antibodies specific for each dengue virus serotype (DEN-1, DEN-2, DEN-3, and DEN-4) by ELISA assay and/or PRNT assay as described previously. The ability of sera of inoculated monkeys to neutralize each of the four dengue virus serotypes is determined by PRNT assay. A negative control for the PRNT assays consists of a pool of the sera obtained from monkeys prior to being immunized A "prime" is typically defined as the first immunization.

The effectiveness of the prophylactic administration of recombinant polypeptide-encoding nucleotide acids of the invention in such amount(s) is assessed by challenge of the immunized monkeys with one or more dengue viruses, preferably of multiple dengue virus serotypes, and observation of the occurrence of viremia (including, e.g., onset, levels, and duration of viremia) or nonoccurrence of viremia in such monkeys thereafter.

Groups of monkeys are selected for in vivo challenge with one or more live dengue viruses of the four serotypes. For one challenge study, monkeys are challenged with a dengue virus at about 9 or at about 12 months after the initial immunization. For a second challenge study, monkeys are challenged with a dengue virus at about 15 or at about 18 months after the initial immunization. For each challenge study, a control group of monkeys is also maintained and observed for comparison. Serum is obtained by bleeding from each monkey prior to the viral challenge. Then, each monkey is inoculated via, e.g., subcutaneous injection in a leg or arm with about 0.5 ml of a solution comprising about $1 \times 10^2$ to about $5 \times 10^4$ plaque forming units (p.f.u.) (typically about $1 \times 10^2$ to about $1.5 \times 10^4$ p.f.u., $1 \times 10^2$ to about $1.25 \times 10^4$ p.f.u., about $1 \times 10^3$ p.f.u. or about $1.25 \times 10^4$ p.f.u.) of a live dengue virus of one of the four serotypes. At least two monkeys are injected with a dengue virus of one serotype; all dengue virus serotypes are employed in each challenge study.

Sera are obtained by bleeding the inoculated and control monkeys at about 15 and about 30 days after initial challenge; alternatively, sera can be obtained at other days following initial challenge. Viremia and antibodies specific for each dengue virus serotype are measured in the sera. Viremia is measured by following the procedure set forth in Raviprakash et al., *J. Gen. Virology* 81:1659-1667 (2000). Antibody response is measured as described previously or by methods known in the art (see, e.g., Raviprakash et al., *J. Gen. Virology* 81:1659-1667 (2000)). Responses in monkeys immunized with a plasmid vector encoding a recombinant antigen of the invention are compared with monkeys injected with the null vector or with carrier alone.

For those monkeys inoculated with a plasmid vector comprising a recombinant dengue virus antigen-encoding nucleic acid of the invention that survive challenge with a particular dengue virus, such recombinant dengue virus antigen-encoding nucleic acid induces a protective immune response against infection by such dengue virus. Protection may be full or partial protection. Full protection is observed in those immunized monkeys that are completely protected from developing viremia; partial protection is observed in those immunized monkeys that only develop a reduced viremia compared to control monkeys.

The present invention includes recombinant nucleic acids that encode recombinant PRM15/tE dengue virus antigen fusion proteins and/or recombinant C15/full length prM/full length E dengue virus antigen fusion proteins (and vectors thereof) that induce protective immune response(s) in vivo against dengue virus infection by at least one dengue virus serotype, preferably against at least two dengue virus serotypes, more preferably against at least three or at least four dengue virus serotypes, following in vivo challenge by one or more dengue virus serotypes in a non-human primate model, e.g., rhesus macaque monkey model.

In another aspect, the invention includes recombinant nucleic acids that encode recombinant tE dengue virus antigen fusion proteins and/or recombinant full length prM/full length E dengue virus antigen fusion proteins (and vectors thereof) that induce protective immune response(s) in vivo against dengue virus infection by at least one dengue virus serotype, preferably against at least two dengue virus serotypes, more preferably against at least three or at least four dengue virus serotypes, following in vivo challenge by one or more dengue virus serotypes, in a non-human primate model. In such aspect, the encoded recombinant polypeptide does not include the PRM15 signal peptide or C15 signal peptide.

The invention also includes neutralizing antibodies that protect against dengue virus infection by one of the four dengue virus serotypes. Such antibodies are produced in response to administration to a subject of a recombinant nucleic acid that encodes a recombinant PRM15/tE dengue virus antigen fusion protein or a recombinant C15/full length prM/full length E dengue virus antigen fusion protein and can be isolated by standard methods from the sera of such subjects. Vectors comprising such nucleic acids may be administered to the subject.

Example 28

This example illustrates a method of immunization of rhesus macaque monkeys with an effective amount of one or more recombinant dengue virus polypeptide antigens of the invention sufficient to induce a protective immune response(s) in the monkeys against one or more (and preferably against two or more) dengue viruses. Such an amount may be an immunogenic amount or an antigenic amount.

Immunization methodologies using dengue virus antigens and primates have been described, and such methods can alternatively be employed herein or adapted as desired. See, e.g., Eckels et al., *Amer J Medicine and Hygiene* (1994) 50:472-487; Raviprakash et al, J. Gen. Virol. (2000) 81: 1659-1667).

A recombinant polypeptide of the invention can be used in the methods described below. Each study is conducted according to the guidelines in "Guide for the Care and Use of Laboratory Animals, Institute of Laboratory Animal Resources," National Research Council, DHHS Publication No. NIH-86-23 (1985). Animals are obtained from the Walter Reed Army Institute of Research animal facility in Forest Glen, Md.

Rhesus macaque monkeys (*Macaca mulatta*), aged approximately 7 to 24 years, are pre-tested for the presence of antibodies against dengue viruses of each of the four dengue virus serotypes by ELISA assay and plaque-reduction neutralization test. Those monkeys that do not show evidence of exposure to such dengue viruses (e.g., are sero-negative for such dengue viruses) are divided into several groups of three monkeys/group. Each monkey in a non-control group is inoculated intramuscularly (i.m.) or intradermally (i.d.) on day 0 with a composition comprising an immunogenic amount or antigenic amount (e.g., about 0.1 μg-1 mg, about 0.5-500 μg, about 0.5-100 μg, about 1-50 μg, about 1-10 μg, about 5-30 μg, about 15-25 μg, or about 0.5 μg to about 2 μg) of a recombinant polypeptide of the invention in a carrier (as described in Example 22). The carrier may comprise, e.g., an endotoxin-free carrier, such as, e.g., a pharmaceutical carrier (e.g., PBS or another suitable saline buffer, 0.1M NaCl, or any suitable carrier which maintains the pH of the solution at about 7.4) and may optionally comprise additional excipients such as preservative agents. The recombinant polypeptide may be administered with an adjuvant (e.g., Freund's incomplete adjuvant (FIA) or aluminum hydroxide) and/or liposome(s) in an amount such as is typically delivered with a DNA vector or DNA vaccine. One of skill can determine the type of adjuvant or liposome and the amount to be included. One group of monkeys serves as the control groups; monkeys of the control group are mock immunized with PBS or another suitable saline solution.

Alternatively, a monkey is administered with a composition comprising a carrier (e.g., pharmaceutically acceptable carrier) and a nucleic acid vector encoding a recombinant polypeptide of the invention. A sufficient amount of the composition is administered such that an immunogenic amount or antigenic amount of the encoded polypeptide is produced (e.g., from about 50 μg to about 10 mg, about 100 μg to about 5 mg, about 1-5 mg, or from about 2-5 mg nucleic acid is administered). Typically, the carrier is PBS. At least one adjuvants and/or liposome may be included in the composition in an amount as is typically delivered with a DNA vector or DNA vaccine. One of skill could readily determine the type of adjuvant or liposome and the amount to be included.

In one study, a group(s) of monkeys is administered with at least one recombinant dengue virus polypeptide of the invention comprising a PRM15/tE dengue virus antigen fusion protein (or combination of such polypeptides). For example, such polypeptide(s) may comprise one or more of the following sequences: SEQ ID NOS:66 (clone 2G11), 67 (clone 5/21), 69 (clone 6E12), 89 (clone 16B4), 93 (clone 16G11), 109 (clone 18H2), 108 (clone 18E11), and 110 (clone 18H6). Alternatively, the recombinant polypeptide that is administered comprises a recombinant tE dengue virus polypeptide antigen and does not include a PRM15 signal peptide.

In a second study, a group(s) of monkeys is administered with at least one recombinant dengue virus polypeptide of the invention comprising a recombinant C15 signal peptide/full length prM/full length E dengue virus antigen fusion protein. Such polypeptide comprises, e.g., one of the following sequences: SEQ ID NOS:250 (clone 16G11-D4), 251 (clone 16G11-25B10ext), 252 (clone 18H6-D4), and 253 (clone 18H6-25B10ext). Alternatively, the recombinant polypeptide that is administered comprises a recombinant full length prM/full length E dengue virus antigen fusion protein and does not include a C15 signal peptide. As will be understood by those of skill, other polypeptides of the invention may be employed in these methods. Preferably, a recombinant tetravalent dengue virus polypeptide antigen of the invention is employed.

As described in Example 27, such recombinant dengue virus polypeptide can be optionally be administered with one or more transfection promoting agents (including, e.g., known agents and those described herein), one or more immunostimulatory sequences (e.g., nucleotide sequences comprising CpG islands or unmethylated CpG motifs, ISS motifs), one or more cytokines (e.g., GM-CSF), one or more adjuvants, and/or one or more costimulatory molecule polypeptides (e.g., B7-1 polypeptide, B7-2 polypeptide, a novel co-stimulatory polypeptide described in International Patent Application WO 02/00717, filed Jun. 22, 2001 (including e.g., CD28 binding protein, such as CD28BP-15), or a combination thereof, as well as a carrier(s) or excipient(s), such as, e.g., a preservative agent(s).

The manner of administration of the polypeptide compositions can be any of those described herein, including, e.g., but not limited to, needle injection, impression through the skin, subcutaneous administration, parenteral administration, oral delivery, inhalation, or topical or transdermal delivery (e.g., using a transdermal patch or ointment). The total amount of recombinant polypeptide administered depends upon the manner of administration. For administration via needle injection, about 0.1 µg-1 mg, about 0.5-500 µg, about 0.5-100 µg, about 1-50 µg, about 1-10 µg, about 5-30 µg, about 15-25 µg, or about 0.5 µg to about 2 µg of such recombinant polypeptide can be administered. One of skill in the art can readily determine the amount of polypeptide preferable for other routes of administration.

The total volume of the polypeptide composition for each immunization typically depends upon the amount or dose of polypeptide (in mg) to be administered as described in Example 27. The total volume of the composition can be administered in one administration or divided into several smaller volumes administered in several administrations consecutively, sequentially, or simultaneously, at one or more sites in the animal. For example, for intramuscular administration, the total volume of the polypeptide composition may be administered to a monkey in one injection or two injections in a muscle of the monkey, such as, e.g., the tibialis anterior muscle. For intradermal administration, a similar total volume of polypeptide composition can be divided into smaller, equal volumes and delivered to a monkey (e.g., anterior thoracic dermal area of monkey) in multiple administrations. One of skill in the art can employ and/or adapt other administration formats, volumes, and compositions known in the art.

The immunizations (e.g., vaccinations) are repeated at least about two times after the initial inoculation with identical polypeptide in the same amount and concentration. Each subsequent inoculation or immunization with the polypeptide is termed a "boost." The second inoculation or immunization (e.g., the first "boost" following the initial inoculation) is administered about 2 weeks to 1 month after the initial inoculation, and a third inoculation (e.g., the second "boost") is administered about 1 to about 6 months following the second inoculation (most typically from about 3 months, 4 months, or about 6 months). Control animals are administered with a carrier (e.g., pharmaceutical carrier) alone in the same volume during the second and third inoculations following the initial inoculation.

Alternatively, for another group(s) of monkeys, one or more DNA or RNA sequences of the invention (as described above) can be used for one or more of the inoculation boosts following the initial inoculation, as described in Example 27. The effectiveness of boosts using a polypeptide antigen of the invention versus an immunogen-encoding or antigen-encoding DNA or RNA sequence of the invention is compared.

Following the procedures set forth in Example 27, sera are obtained from each monkey, and such sera are tested for the presence of antibodies specific for each dengue virus serotype (DEN-1, DEN-2, DEN-3, and DEN-4) by ELISA assay and/or PRNT assay. The ability of sera of inoculated monkeys to neutralize each of the four dengue virus serotypes is determined by PRNT assay.

Effectiveness of the prophylactic administration of such recombinant polypeptide(s) of the invention is assessed by challenge of the immunized monkeys with one or more dengue viruses, preferably of multiple dengue virus serotypes, and observation of the occurrence of viremia (including, e.g., onset, levels, and duration of viremia) or nonoccurrence of viremia in such monkeys thereafter, as described in Example 27.

The administration of an effective amount (e.g., immunogenic amount or antigenic amount) of one or more recombinant polypeptides of the invention to a nonhuman primate induces a protective immune response against in vivo challenge by at least one dengue virus. Protection may be full or partial protection. Full protection is observed in those immunized monkeys that are completely protected from developing viremia; partial protection is observed in those immunized monkeys that only develop a reduced viremia compared to control monkeys.

The present invention includes recombinant PRM15/tE dengue virus antigen fusion proteins and recombinant C15/full length prM/full length E dengue virus antigen fusion proteins (and compositions thereof) that induce protective immune response(s) in vivo against dengue virus infection by at least one dengue virus serotype, preferably at least two dengue virus serotypes, more preferably at least three or at least four dengue virus serotypes, following in vivo viral challenge by one or more dengue virus serotypes, in a nonhuman primate model, e.g., rhesus macaque monkey model.

In another aspect, the invention also includes recombinant truncated E dengue virus antigen fusion proteins and recombinant full length prM/full length E dengue virus antigen fusion proteins (and compositions thereof) that induce protective response(s) in vivo against dengue virus infection by at least one dengue virus serotype, preferably at least two dengue virus serotypes, more preferably at least three or at least four dengue virus serotypes, following in vivo viral challenge by one or more dengue virus serotypes, in a non-human primate model. In such aspect, the encoded recombinant polypeptide does not include the PRM15 signal peptide or C15 signal peptide.

Example 29

This example illustrates a method of immunization of a human with a composition comprising a pharmaceutically acceptable carrier (e.g., PBS) and at least one recombinant immunogen-encoding or antigen-encoding DNA or RNA sequence of the invention or with at least one human codon optimized DNA or RNA sequence of the invention described herein. For example, any recombinant PRM15/tE fusion protein-encoding nucleotide sequence, including, e.g., but not limited to, any of SEQ ID NOS:157 (clone 2G11), 158 (clone 5/21), 159 (clone 6E12), 185 (clone 16B4), 187 (clone 16G11), 200 (clone 18H2), 172 (clone 18E11), 235 (clone 18H6), or any composition or mixture of such nucleotide sequences, or any recombinant C15/full length prM/full length E fusion protein-encoding nucleotide sequence, including, e.g., but not limited to, any of SEQ ID NOS:254 (clone 16G11-D4), 255 (clone 16G11-25B10ext), 256 (clone 18H6-D4), 257 (clone 18H6-25B10ext), 204 (2G11-D4), and 202 (6E12-D4), or any mixture of such nucleotide sequences, can be employed in this method. In another aspect, a composition comprising a pharmaceutically acceptable carrier and at least one recombinant PRM15/tE fusion protein-encoding nucleotide sequence and at least one recombinant C15/full length prM/full length E fusion protein-encoding nucleotide sequence can be employed (e.g., 18H6 (SEQ ID NO:235), 2G11-D4 (SEQ ID NO:204), and 6E12-D4 (SEQ ID NO:202). Other immune-stimulating polynucleotides of the invention or combinations of such polynucleotides can also be used in this method.

Immunization of a human with one or more recombinant DNA or RNA sequences of the invention is done using a method similar to that described in Example 27. Prophylactic administration of an effective amount (e.g., immunogenic amount or antigenic amount) of one or more such DNA or RNA sequences of the invention to a human results in the induction or enhancement of an immune response against at least one, and preferably at least two, at least three, or at least four, dengue viruses in the human. For such polynucleotides of the invention, a protective immune response against one or more dengue viruses is induced or enhanced in the human recipient. Such response may be a partially protective response, but is preferably a fully protective response. Such polynucleotide or combination of several different recombinant polynucleotides serves as a DNA vaccine that induces an immune response(s) that protects against infection by at least one, preferably at least two, and more preferably at least three or four dengue virus serotypes.

In addition, the invention provides methods of prophylactic immunization of humans with one or more recombinant dengue virus polypeptides of the invention in, e.g., a suitable carrier, such as a pharmaceutically acceptable carrier (PBS), and optionally any acceptable adjuvant, such as alum. Immunization of a human with one or more recombinant polypeptides of the invention is conducted using a method similar to that described in Example 27. Any recombinant polypeptide of the invention or combination of such polypeptides can be used for human immunization; for example, such polypeptide may comprise one or more of the following sequences: SEQ ID NOS:66 (clone 2G11), 67 (clone 5/21),69 (clone 6E12), 89 (clone 16B4), 93 (clone 16G11), 109 (clone 18H2), 108 (clone 18E11),and 110 (clone 18H6) or 251 (16G11-25B10). Alternatively, the recombinant polypeptide that is administered comprises a recombinant tE dengue virus polypeptide antigen and does not include a PRM15 signal peptide. In another aspect, a combination of two or more any of the recombinant polypeptides of the invention can be administered.

Such polypeptides can be administered to a human in addition to a polynucleotide or, alternatively, in place of such polynucleotide. The recombinant polypeptide is administered to the human in an amount effective to induce or enhance an immune response(s) in the human. The effective amount comprises, e.g., immunogenic amount or antigenic amount. Suggested doses were described above. Such antigenic polypeptides may serve as protein vaccines. Administration of the polypeptide can be via a variety of routes, as described above; transdermal and intramuscular administration via injection are among the typical routes of polypeptide delivery.

Amounts of recombinant dengue virus polynucleotides and polypeptides used for the immunization of rhesus macaque monkeys in Examples 27 and 28 can be similarly used for the immunization of humans; alternatively, such amounts can be modified proportionally to take into account the size of the human relative to that of the macaque monkey. For example, the dose of dengue virus peptide antigen for immunization of a human may be slightly higher (e.g., about 0.5 μg-1 mg, about 0.5-500 μg, about 0.5-100 μg, about 1-50 μg, about 1-10 μg, about 5-30 μg, about 15-25 μg) compared to the immunization dose used for a monkey. The prophylactic administration of an effective amount of one or more recombinant dengue virus polypeptide antigens of the invention induces in a human a protective immune response against at least one, preferably at least two, and more preferably at least three or at least four, dengue viruses.

Such polypeptides and polynucleotides of the invention can be formulated as a composition with a carrier or excipient, including as a pharmaceutical composition, as described herein, and can be administered to a human by a variety of routes as described herein (see also Examples 27 and 28). Such polynucleotides can be delivered via a vector as described herein (see, e.g., Example 27). The recombinant dengue virus polypeptide of the invention can be administered alone (e.g., as a protein vaccine) or in combination (before or after) with administration of a plasmid vector comprising the corresponding polypeptide-encoding polynucleotide of the invention. Other formats are set forth in Example 28.

Similarly, the polynucleotide can be administered alone via a plasmid vector (e.g., as a DNA vaccine) or in combination (before or after) with administration of the corresponding encoded polypeptide of the invention, and a variety of boosting strategies and methodologies can also be employed, as described in, e.g., in Examples 27 and 28. For example, at least one such recombinant polynucleotide (e.g., recombinant DNA vaccine) or at least such recombinant polypeptide (e.g., recombinant protein vaccine) can be administered to a human initially in an amount effective to induce an immune response, and after an appropriate time period (which can be determined by one of skill in the art) (e.g., about one week, about one month, about 4, about 5, about 6, about 12, or about 18 months, etc.), a "boost" immunization comprising the same or a different amount of the polynucleotide (DNA vaccine) or polypeptide (protein vaccine) can be administered to the same human. If desired, multiple boosts can be administered to the human.

In another aspect, the invention provides methods comprising the administration to a human of an effective amount of a composition comprising at least one nucleic acid encoding at least one dengue virus antigen of the invention in combination with one or more nucleic acids encoding one or more WT dengue virus prM/E fusion proteins, WT dengue virus PRM15/tE fusion proteins, and/or WT C15/full length prM/full length E fusion proteins, and, optionally, a nucleotide encoding a co-stimulatory molecule or cytokine, such as GM-CSF or an interferon, or combination of such co-stimulatory molecule-encoding nucleotides and/or cytokine-encoding nucleotides, wherein the amount is sufficient to induce a protective immune response against at least one, at least two, and preferably at least three or at least four dengue virus serotypes.

In yet another aspect, the invention provides methods comprising the administration to a human of an effective amount of a composition comprising at least one recombinant dengue virus antigen of the invention in combination with one or more WT dengue virus prM/E fusion proteins, WT dengue virus PRM15/tE fusion proteins, and/or WT C15/full length prM/full length E fusion proteins, and, optionally, one or more co-stimulatory molecules or cytokines, such as GM-CSF or an interferon, or combination of such co-stimulatory molecules and/or cytokines, wherein the amount is sufficient to induce a protective immune response against at least one, at least two, and preferably at least three or at least four dengue virus serotypes.

In all such methods and formats described herein, the resulting induced immune response(s) induced in the human who received the one or more immunizations of a polynucleotide(s) and/or polypeptide(s) can be determined at various times, including before and/or after the various immunizations, by measuring, e.g., the antibody titer level in serum (blood) obtained from the human using ELISA assays and/or PRNT assays described above.

The sequence listing is shown below.

While the foregoing invention has been described in some detail for purposes of clarity and understanding, it will be clear to one skilled in the art from a reading of this disclosure that various changes in form and detail can be made without departing from the true scope of the invention. It is understood that the examples and embodiments described herein are for illustrative purposes only and that various modifications or changes in light thereof will be suggested to persons skilled in the art and are to be included within the spirit and purview of this application and scope of the appended claims. For example, all the techniques and apparatus described above may be used in various combinations.

All references, including publications, patent applications, patents, and/or other documents cited herein, including those not specifically indicated as being incorporated by reference when cited above, are each hereby incorporated by reference in their entirety for all purposes to the same extent as if each such reference were individually and specifically indicated to be incorporated by reference herein in its entirety for all purposes and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. Terms such as "including," "having," "comprising," "containing," and the like are to be construed as open-ended terms (i.e., meaning "including, but not limited to") unless otherwise indicated, and as encompassing the phrases "consisting of" and "consisting essentially of." Recitation of ranges of values herein are merely intended to serve as a shorthand method of referring individually to each separate value of the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention. The headings provided in the description of the invention are included merely for convenience and are not intended to be limiting in the scope of the disclosure.

The citation of any patent or patent document herein does not reflect any view concerning the patentability of the subject matter described or claimed in such patent documents. Rather, such patent documents may be cited merely to provide convenient reference for suitable techniques and compositions, including techniques and compositions otherwise well known in the art.

All amino acid or nucleotide sequences of one of the aforementioned sequence patterns are to be considered individually disclosed herein. Thus, for example, an amino acid sequence pattern of three residues, where a "Xaa" represents one of the amino acid positions in the pattern represents a disclosure of twenty different amino acid sequences (i.e., one sequence for each naturally occurring amino acid residue that could be present in the Xaa position).

Any of the techniques and any of the characteristics of the viral vector particle compositions of the invention can be combined in any suitable manner, unless otherwise stated or clearly contradicted by context.

Preferred embodiments and aspects of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (345 sequences)

SEQ ID NO: 1 - protein, 446 aa, Artificial Sequence
  Synthetic polypeptide: 2/7-NPRM ("NPRM"= no prM seq)
MRCIGISNRDFVEGVSGATWVDVVLEHGSCVTTMAKNKPTLDIELIKTEATQPATLRKYCIEAKLTNTTTESRCPTQGEPYLKEEQDQNYVCKHTYVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKTWLVHKQWFLDLPLPWTAGASTSQETWNRKELLVTFKNAHAKKQEVVVLGSQEGAMHTALTGATEVDSGDGNLLFTGHLKCRLKMDKLQLKGMSYSMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFESTYRGAKRMAILGETAWDFGSVGGVFTSIGKALHQVFGAIYGA

SEQ ID NO: 2 - protein, 447 aa, Artificial Sequence
  Synthetic polypeptide: 2G11-NPRM (no prM seq)
MRCVGIGNRDFVEGLSGATWVDVVLEHGGCVTTMAKNKPTLDFELIKTTAKEVALLRTYCIEASISNITTATRCPTQGEPYLKEEQDQQYICRRDVVDRGWGNGCGLFGKGSLITCAKFKCVTKLEGNIVQPENLEYTIVITPHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHSALAGATEIQMSSGNLLFTGHLKCRLKMDKLQLKGMSYTMCTGKFQIVKEIAETQHGTILIKVEYKGEDAPCKIPFSTEDEKGVTQNGRLITANPIVTEKDSPVNIEAEPPFGESYIVVGAGEKALKLSWFKKGSSIGQMFESTYRGAKRMAILGETAWDFGSVGGLLTSLGKAVHQVFGSVYTTMFG

SEQ ID NO: 3 - protein, 446 aa, Artificial Sequence
  Synthetic polypeptide: 5/21-NPRM (no prM seq)
MRCVGVGNRDFVEGLSGATWVDVVLEHGSCVTTMAKNKPTLDIELLKTEVTNPATLRKYCIEAKITNITTDSRCPTQGEAILPEEQDQNYVCKHTYVDRGWGNGCGLFGKGSLVTCAKFTCKKNMEGNIVQPENLEYTIVITPHSGEEHAVGNDTGKHGKEIKITPQSSITEAELTGYGTVTMECSPRTGLDFNRVVLLTMKKKSWLVHKQWFLDLPLPWTAGADTSEVHWNHKERMVTFKVPHAKRQDVTVLGSQEGAMHSALAGATEIQMSSGNLLFTGHLKCRLRMDKLQLKGMSYVMCTGKFQIVKEIAETQHGTIVIRVQYEGDGSPCKIPLEIMDLEKRHVLGRLITVNPIVIDKEKPVNIEAEPPFGESYIVVGVGDSALTLHWFRKGSSIGQMFETTMRGAKRMAILGDTAWDFGSLGGVFTSIGKALHQVFGAIYGA

SEQ ID NO: 4 - protein, 427 aa, Artificial Sequence
  Synthetic polypeptide: 6C6-NPRM (no prM seq)
MRCVGIGNRDFVEGVSGGAWVDLVLEHGGCVTTMAKNKPTLDFELIKTTAKEVALLRTYCIEASISNITTATRCPTQGEPYLKEEQDQQYICRRDVVDRGWGNGCGLFGKGGIVTCAMFTCKKNMEGNIVQPENLEYTIVITPHSGEEHAVGNDTGKHGKEIKITPQSSITEAELTGYGTVTMECSPRTGLDFNEMILMKMKNKAWMVHRQWFLDLPLPWTAGADTETPTWNRKELLVTFKNAHAKKQEVVVLGSQEGAMHSALAGATEVDSGDGNHMFAGHLKCKVRMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFKKGSSIGKMFEATARGARRMAILGDTAWDFGSAYT

SEQ ID NO: 5 - protein, 448 aa, Artificial Sequence
  Synthetic polypeptide: 6E12-NPRM (no prM seq)
MRCVGVGNRDFVEGLSGATWVDVVLEHGSCVTTMAKNKPTLDIELLKTEVTNPAVLRKLCIEASISNITTATRCPTQGEAILPEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKTAHAKKQDVVVLGSQEGAMHTALTGATEIQMSSGTTTIFAGHLKCKVRMDKLTLKGVSYVMCTGSFKLEKEVAETQHGTVLVQVKYEGTDAPCKIPFSSQDEKGVTQNGRLITANPIVIDKEKPVNIEAEPPFGDSYIIIGVEPGQLKLHWFKKGSSIGQMFETTMRGAKRMAILGDTAWDFGSVGGLLTSLGKMVHQIFGSVYTTMFG

SEQ ID NO: 6 - protein, 444 aa, Artificial Sequence
  Synthetic polypeptide: 6F4-NPRM (no prM seq)
MRCVGIGNRDFVEGVSGGAWVDLVLEHGGCVTTMAKNKPTLDFELIKTEATQPATLRKYCIEAKLTNTTTESRCPTQGEAILPEEQDQQYICRRDVVDRGWGNGCGLFGKGSLITCAKFQCLEPIEGKVVQHENLKYTVIITVHTGDQHQVGNDTQGVTVEITPQASTVEAILPEYGTLGLECSPRTGLDFNEMILLTMKKKSWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFKKGSSIGQMFEATARGARRMAILGDTAWDFGSVGGVFTSIGKALHQVFGAIYGA

SEQ ID NO: 7 - protein, 448 aa, Artificial Sequence
  Synthetic polypeptide: 7A9-NPRM (no prM seq)
MRCVGIGNRDFVEGVSGATWVDVVLEHGGCVTTMAKNKPTLDIELQKTEATQLATLRKLCIEASISNITTATRCPTQGEATLVEEQDTNFVCRRTFVDRGWGNGCGLFGKGSLVTCAKFQCLEPIEGKVVQHENLKYTIVITPHSGEEHAVGNDTGKHGKEIKITPQSSITEAELTGYGTVTMECSPRTGLDFNEMILLTMKSKTWLVHKQWFLDLPLPWTAGADTSEVHWNHKERMVTFKNAHAKKQEVVVLGSQEGAMHTALTGTTEIQNSGNLLFTGHLKCRLRMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFRKGSSIGKMFESTYRGAKRMAILGETAWDFGSVGGLLTSLGKAVHQVFGSVYTTMFG

SEQ ID NO: 8 - protein, 444 aa, Artificial Sequence
  Synthetic polypeptide: 11B1-NPRM (no prM seq)
MRCIGISNRDFVEGVSGATWVDVVLEHGSCVTTMAKNKPTLDIELIKTEATQPATLRKYCIEAKLTNTTTATRCPTQGEAILPEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNHKERMVTFKVPHAKRQDVTVLGSQEGAMHTALTGATEVDSGDGNHMFAGHLKCRLKMDKLQLKGMSYSMCTGKFQIVKEIAETQHGTIVIRVQYEGDGSPCKIPLEIMDLEKRHVLGRLITANPIVTEKDSPVNIEAEPPFGDSYIIIGVEPGQLKLHWFRKGSSIGQMFESTYRGAKRMAILGETAWDFGSVGGLLTSLGKAVHQVFGAIYGA

SEQ ID NO: 9 - protein, 447 aa, Artificial Sequence
  Synthetic polypeptide: 11B8-NPRM (no prM seq)
MRCVGVGNRDFVEGLSGATWVDVVLEHGSCVTTMAKNKPTLDIELLKTEVTNPATLRKYCIEAKLTNTTTESRCPTQGEPYLKEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNRVVLLTMKKKTWLVHKQWFLDLPLPWTAGADTETPTWNRKELLVTFKNAHAKKQEVVVLGSQEGAMHSALAGATEIQMSSGNHMFAGHLKCKVRMEKLQLKGMSYVMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGQMFEATARGARRMAILGDTAWDFGSVGGLLTSLGKMVHQIFGSVYTTMFG

SEQ ID NO: 10 - protein, 427 aa, Artificial Sequence
  Synthetic polypeptide: 11C4-NPRM (no prM seq)
MRCVGIGNRDFVEGLSGATWVDVVLEHGSCVTTMAKNKPTLDIELLKTEVTNPATLRTYCIEASISNITTESRCPTQGEPYLKEEQDQNYVCKHTYVDRGWGNGCGLFGKGSVVTCAKFQCLEPIEGKVVQHENLKYTIVITPHSGEEHAVGNDTGKHGKEIKITPQSSITEAELTGYGTVTMECSPRTGLDFNEMILLTMKSKTWLVHKQWFLDLPLPWTAGADTSQETWNRKELLVTFKNAHAKKQEVVVLGSQEGAMHTALTGATEVDSGDGNLLFTGHLKCRLKMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVGDKALKLHWFKKGSSIGKMFEATARGAKRMAILGETAWDFGSAYT

SEQ ID NO: 11 - protein, 444 aa, Artificial Sequence
  Synthetic polypeptide: 11C11-NPRM (no prM seq)
MRCVGVGNRDFVEGLSGATWVDVVLEHGSCVTTMAKNKPTLDIELLKTEVTNPAVLRKLCIEASISNITTESRCPTQGEPYLKEEQDQNYVCKHTYVDRGWGNGCGLFGKGSLITCAKFKCVTKLEGKIVQYENLKYSVIVTVHTGDQHQVGNETQGVTVEITPQASTVEAILPEYGTLGLECSPRTGLDFNEMILLTMKKKTWLVHKQWFLDLPLPWTAGADTSQETWNRKELLVTFKNAHAKKQEVVVLGSQEGAMHTALTGATEVDSGDGNLLFTGHLKCRLKMDKLQLKGMSYSMCTGKFQIVKEIAETQHGTIVIRVQYEGEDAPCKIPFSTEDGQGKAHNGRLITANPIVTEKDSPVNIEAEPPFGDSYIVVGAGEKALKLHWFKKGSSIGQMFEATARGARRMAILGDTAWDFGSVGGVFTSIGKALHQVFGAIYGA

SEQ ID NO: 12 - protein, 446 aa, Artificial Sequence
  Synthetic polypeptide: 11E2-NPRM (no prM seq)
MRCVGVGNRDFVEGLSGATWVDVVLEHGSCVTTMAKNKPTLDIELLKTEVTNPAVLRKLCIEASISNITTATRCPTQGEAILPEEQDQNYVCKHTYVDRGWGNGCGLFGKGSLVTCAKFKCVTKLEGKIVQYENLKYSVIVTVHTGDQHQVGNETTEHGTIATITPQAPTSEIQLTDYGALTLDCSPRTGLDFNRVVLLTMKKKTWLVHKQWFLDLPLPWTAGASTSQETWNRKELLVTFKNAHAKRQDVTVLGSQEGAMHSALTGATEIQMSSGNLLFAGHLKCRLKMDKLQLKGMSYSMCTGKFQIVKEIAETQHGTIVIRVQYEGDGAPCKIPLEIMDLEKRHVLGRLITVNPIVTEKDSPVNIEAEPPFGESYIVVGVGDSALTLHWFRKGSSIGQMFEATARGAKRMAILGDTAWDFGSVGGVFTSIGKALHQVFGAIYGA

SEQ ID NO: 13 - protein, 449 aa, Artificial Sequence
  Synthetic polypeptide: 12E3-NPRM (no prM seq)
MRCVGVGNRDFVEGLSGATWVDVVLEHGSCVTTMAKNKPTLDIELIKTTAKEVALLRTYCIEASISNITTATRCPTQGEAILPEEQDQNYVCKHTYVDRGWGNGCGLFGKGSLVTCAKFTCKKNMEGNIVQPENLEYTIVITPHSGEEHAVGNDTGKHGKEIKITPQSSITEAELTGYGTVTMECSPRTGLDFNRVVLLTMKKKSWLVHKQWFLDLPLPWTAGASTSQETWNRKELLVTFKNAHAKKQEVVVLGSQEGAMHTALTGATEIQMSSGNLLFTGHLKCRLRMDKLQLKGMSYSMCTGKFQIVKEIAETQHGTIVIRVQYEGDGAPCKIPFSTEDGQGKAHNGRLITANPIVIDKEKPVNIELEPPFGESYIVVGAGDKALKINWYKKGSSIGKMFESTYRGAKRMAILGETAWDFGSVGGLLTSLGKAVHQVFGSVYTTMFG

SEQ ID NO: 14 - protein, 425 aa, Artificial Sequence
  Synthetic polypeptide: 12H4-NPRM (no prM seq)
MRCIGISNRDFVEGVSGATWVDVVLEHGSCVTTMAKNKPTLDIELIKTEATQPATLRKYCIEASISNITTDSRCPTQGEPYLKEEQDQQYICRRDVVDRGWGNGCGLFGKGSLITCAKFKCVTKLEGKIVQYENLKYSVIVTVHTGDQHQVGNDTQGVTVEITPQASTVEAILPEYGTLGLECSPRTGLDFNEMILLTMKKKSWLVHKQWFLDLPLPWTAGADTETPTWNRKELLVTFKNAHAKKQEVVVLGSQEGAMHTALTGATEIQMSSGNLLFTGHLKCRLKMDKLQLKGMSYSMCTGKFQIVKEIAETQHGTIVIRVQYEGDGAPCKIPFSTEDEKGVTQNGRLITANPIVTEKDSPVNIEAEPPFGDSYIIIGVEPGQLKLHWFKKGSSIGQMFEATARGARRMAILGDTAWDFGSAYT

SEQ ID NO: 15 - protein, 449 aa, Artificial Sequence
  Synthetic polypeptide: 13E2-NPRM (no prM seq)
MRCVGIGNRDFVEGVSGATWVDVVLEHGGCVTTMAKNKPTLDFELIKTTAKEVALLRTYCIEASISNITTATRCPTQGEPYLKEEQDQQYICRRDVVDRGWGNGCGLFGKGSLITCAKFKCVTKLEGNIVQPENLEYTIVITPHSGEEHAVGNDTGKHGKEIKITPQSSITEAELTGYGTVTMECSPRTGLDFNEMILLTMKKKSWLVHKQWFLDLPLPWTAGASTSQETWNRKELLVTFKNAHAKKQEVVVLGSQEGAMHTALTGATEIQMSSGNLLFTGHLKCRLRMDKLQLKGMSYTMCTGKFQIVKEIAETQHGTIVIRVQYEGTDAPCKIPFSTEDGQGKAHNGRLITANPIVIDKEKPVNIELEPPFGDSYIIIGVEPGQLKLHWFKKGSSIGKMFEATARGAKRMAILGETAWDFGSVGGLLTSLGKMVHQIFGSVYTTMFG

SEQ ID NO: 16 - protein, 446 aa, Artificial Sequence: 13E11-NPRM (no prM seq)
  Synthetic polypeptide:
MRCVGVGNRDFVEGVSGGAWVDVVLEHGGCVTTMAKNKPTLDIELIKTEATQPATLRKYCIEASISNITTDTRCPTQGEPYLKEEQDQNYVCKHTYVDRGWGNGCGLFGKGSLITCAKFKCVTKLEGKIVQYENLKYSVIVTVHTGDQHQVGNETTEHGTIATITPQAPTSEIQLTDYGTVTMECSPRTGLDFNEMILLTMKSKTWLVHKQWFLDLPLPWTAGADTETPTWNRKELLVTFKNAHAKKQEVVVLGSQEGAMHTALAGATEIQMSSGNLLFTGHLKCRLKMDKLQLKGMSYTMCTGKFQIVKEIAETQHGTIVIRVQYEGTDAPCKIPFSTEDGQGKAHNGRLITANPIVIDKEKPVNIELEPPFGESYIVVGAGEKALTLHWFRKGSSIGQMFETTMRGAKRMAILGETAWDFGSVGGVFTSIGKALHQVFGAIYGA

SEQ ID NO: 17 - protein, 446 aa, Artificial Sequence
  Synthetic polypeptide: 13F11-NPRM (no prM seq)
MRCVGIGNRDFVEGVSGGAWVDLVLEHGGCVTTMAKNKPTLDIELIKTEATQPATLRKYCIEAKITNITTDSRCPTQGEPYLKEEQDQQYICRRDVVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKTWLVHKQWFLDLPLPWTAGADTSEVHWNHKERMVTFKVPHAKRQDVTVLGSQEGAMHSALAGATEVDSGDGNHMFAGHLKCRLKMDKLQLKGMSYSMCTGKFQIVKEIAETQHGTIVIRVQYEGDGAPCKIPFSTEDEKGKAHNGRLITANPIVIDKEKPVNIELEPPFGESYIVVGAGEKALKLSWFKKGSSIGKMFESTYRGAKRMAILGDTAWDFGSVGGVFTSIGKALHQVFGAIYGA

SEQ ID NO: 18 - protein, 425 aa, Artificial Sequence
  Synthetic polypeptide: 14B1-NPRM (no prM seq)
MRCVGISNRDFVEGVSGGAWVDLVLEHGGCVTTMAKNKPTLDIELLKTEVTNPATLRKYCIEAKITNITTDSRCPTQGEPYLKEEQDQQYICRRDVVDRGWGNGCGLFGKGSLITCAKFKCVTKLEGNIVQPENLKYTIVITPHTGDQHQVGNDTQGVTVEITPQASTVEAILPEYGTLGLECSPRTGLDFNEMILLTMKKKSWLVHKQWFLDLPLPWTAGADTETPTWNRKELLVTFKNAHAKRQDVTVLGSQEGAMHSALTGATEVDSGDGNLLFTGHLKCRLKMDKLQLKGMSYTMCTGKFQIVKEIAETQHGTIVIRVQYEGDGAPCKIPFSTEDEKGVTQNGRLITANPIVTEKDSPVNIEAEPPFGESYIVVGAGEKALKLSWFKKGSSIGQMFESTARGARRMAILGDTAWDFGSAYT

SEQ ID NO: 19 - protein, 425 aa, Artificial Sequence
  Synthetic polypeptide: 14E9-NPRM (no prM seq)
MRCVGIGNRDFVEGVSGGAWVDLVLEHGGCVTTMAKNKPTLDIELIKTEATQPATLRKYCIEAKITNITTDSRCPTQGEAILPEEQDQQYICRRDVVDRGWGNGCGLFGKGSVVTCAKFQCVTKLEGNIVQPENLEYTIVITPHTGDQHQVGNDTQGVTVEITPQASTVEAILPEYGTLGLECSPRTGLDFNEMILMKMKNKAWMVHKQWFLDLPLPWTSGASTSQETWNRKELLVTFKNAHAKKQEVVVLGSQEGAMHSALAGATEIQMSSGNLLFTGHLKCRLKMDKLQLKGMSYTMCTGKFQIVKEIAETQHGTIVIRVQYEGDGSPCKIPLEIMDLEKRHVLGRLITANPIVIDKEKPVNIELEPPFGDSYIVVGAGDKALKINWYKKGSSIGKMFESTYRGAKRMAILGETAWDFGSAYT

SEQ ID NO: 20 - protein, 446 aa, Artificial Sequence
  Synthetic polypeptide: 14G10-NPRM (no prM seq)
MRCIGISNRDFVEGVSGATWVDVVLEHGGCVTTMAKNKPTLDIELLKTEVTNPATLRKYCIEAKITNITTDTRCPTQGEAILPEEQDQQYICRRDVVDRGWGNGCGLFGKGSLVTCAKFTCKKNMEGNIVQPENLEYTIVITPHSGEEHAVGNETTEHGTIATITPQAPTSEIQLTDYGALTLDCSPRTGLDFNRVVLLTMKKKTWLVHKQWFLDLPLPWTAGADTSEVHWNHKERMVTFKVPHAKRQDVTVLGSQEGAMHSALAGATEIQMSSGNLLFTGHLKCRLKMDKLQLKGMSYSMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFESTYRGAKRMAILGETAWDFGSVGGVFTSIGKALHQVFGAIYGA

SEQ ID NO: 21 - protein, 444 aa, Artificial Sequence
  Synthetic polypeptide: 14H2-NPRM (no prM seq)
MRCVGVGNRDFVEGVSGGAWVDLVLEHGGCVTTMAKNKPTLDFELIKTTAKEVALLRTYCIEAKITNITTATRCPTQGEPYLKEEQDQNYVCKHTYVDRGWGNGCGLFGKGSLITCAKFQCVTKLEGNIVQPENLEYTIVITPHSGEEHAVGNDTQGVTVEITPQASTVEAILTDYGALTLDCSPRTGLDFNRVVLLTMKKKTWLVHKQWFLDLPLPWTAGADTSEVHWNHKERMVTFKVPHAKKQEVVVLGSQEGAMHTALTGATEVDSGDGNLLFTGHLKCRLKMDKLQLKGMSYSMCTGKFQIVKEIAETQHGTIVIRVQYKGEDAPCKIPFSSQDGQGKAHNGRLITANPIVTEKDSPVNIEAEPPFGESYIVVGAGEKALKLSWFKKGSSIGQMFETTMRGAKRMAILGETAWDFGSVGGVFTSIGKALHQVFGAIYGA

SEQ ID NO: 22 - protein, 447 aa, Artificial Sequence
  Synthetic polypeptide: 15C2-NPRM (no prM seq)
MRCVGISNRDFVEGLSGATWVDVVLEHGSCVTTMAKNKPTLDIELLKTEVTNPATLRKYCIEAKITNITTDSRCPTQGEPYLKEEQDQQYICRRDVVDRGWGNGCGLFGKGSVVTCAKFQCLEPIEGKIVQYENLKYSVIVTVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKVPHAKRQDVTVLGSQEGAMHSALAGATEVDSGDGNHMFAGHLKCRLKMDKLQLKGMSYVMCTGKFQIVKEIAETQHGTIVIRVQYEGDGAPCKIPFSTEDEKGVTQNGRLITANPIVIDKEKPVNIEAEPPFGESYIVIGVEPGQLKLHWFKKGSSIGQMFEATARGARRMAILGETAWDFGSVGGLLTSLGKAVHQVFGSVYTTMFG

SEQ ID NO: 23 - protein, 446 aa, Artificial Sequence
  Synthetic polypeptide: 15D4-NPRM
MRCVGIGNRDFVEGLSGATWVDVVLEHGGCVTTMAKNKPTLDFELIKTTAKEVALLRTYCIEAKITNITTDSRCPTQGEAILPEEQDQNYVCKHTYVDRGWGNGCGLFGKGSLITCAKFKCLEPIEGKVVQPENLEYTIVITPHSGEEHAVGNDTGKHGKEIKITPQSSITEAELTGYGTVTMECSPRTGLDFNRVVLLTMKKKSWLVHKQWFLDLPLPWTAGADTSEVHWNHKERMVTFKTAHAKKQDVVVLGSQEGAMHSALAGATEIQMSSGNLLFTGHLKCRLRMDKLTLKGVSYVMCTGSFKLEKEVAETQHGTVLVQVKYEGTDAPCKIPFSTEDEKGVTQNGRLITANPIVTEKDSPVNIEAEPPFGESYIVVGAGDKALKINWYKKGSSIGKMFESTYRGAKRMAILGDTAWDFGSLGGVFTSIGKALHQVFGAIYGA

SEQ ID NO: 24 - protein, 447 aa, Artificial Sequence
  Synthetic polypeptide: 15H4-NPRM
MRCVGVGNRDFVEGLSGATWVDVVLEHGSCVTTMAKNKPTLDFELIKTEVTNPATLRKYCIEASISNITTATRCPTQGEANLPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNRVVLLTMKKKSWLVHKQWFLDLPLPWTAGADTSEVHWNHKERMVTFKTAHAKKQEVVVLGSQEGAMHSALAGATEIQMSSGNLLFTGRLKCRLKMDKLQLKGMSYVMCTGKFQIVKEIAETQHGTIVIRVQYEGDGAPCKIPLEIMDLEKRHVLGRLITVNPIVIDKEKPVNIEAEPPFGDSYIIIGVEPGQLKLHWFKKGSSIGQMFESTYRGAKRMAILGDTAWDFGSVGGVLNSLGKMVHQIFGSVYTTMFG

SEQ ID NO: 25 - protein, 448 aa, Artificial Sequence
  Synthetic polypeptide: 16B4-NPRM
MRCVGVGNRDFVEGLSGATWVDVVLEHGSCVTTMAKNKPTLDIELLKTEVTNPAVLRKLCIEASISNITTDSRCPTQGEAILPEEQDQNYVCKHTYVDRGWGNGCGLFGKGSLITCAKFKCLEPIEGKVVQHENLKYTVIITVHTGDQHQVGNDTQGVTVEITPQASTVEAILPEYGTLGLECSPRTGLDFNEMILLTMKKKTWLVHKQWFLDLPLPWTAGADTSEVHWNHKERMVTFKTAHAKKQDVVVLGSQEGAMHTALTGATEIQMSSGTTTIFAGHLKCRLKMDKLQLKGMSYTMCTGKFQIVKEIAETQHGTILIKVEYKGEDAPCKIPFSTEDEKGVTQNGRLITANPIVTEKDSPVNIEAEPPFGESYIVVGVGDKALKINWYKKGSSIGQMFETTMRGAKRMAILGDTAWDFGSVGGLLTSLGKMVHQIFGSVYTTMFG

SEQ ID NO: 26 - protein, 444 aa, Artificial Sequence
  Synthetic polypeptide: 16E8-NPRM
MRCVGVGNRDFVEGLSGATWVDVVLEHGGCVTTMAKNKPTLDFELIKTTAKEVALLRTYCIEASISNITTATRCPTQGEPYLKEEQDQQYICRRDVVDRGWGNGCGLFGKGSLITCAKFKCVTKLEGNIVQPENLEYTIVITPHTGDQHQVGNDTQGVTVEITPQASTVEAILPEYGTLGLECSPRTGLDFNEMILLTMKNKAWMVHKQWFLDLPLPWTSGATTETPTWNRKELLVTFKTAHAKKQDVVVLGSQEGAMHTALTGATEIQMSSGNLLFTGHLKCRLRMDKLQLKGMSYVMCTGKFQIVKEIAETQHGTILIKVEYKGEDAPCKIPFSTEDGQGKAHNGRLITANPIVIDKEKPVNIEAEPPFGESNIVIGIGDKALKINWYKKGSSIGKMFETTMRGAKRMAILGDTAWDFGSVGGVFTSIGKALHQVFGAIYGA

SEQ ID NO: 27 - protein, 447 aa, Artificial Sequence
  Synthetic polypeptide: 16E10-NPRM (no prM seq)
MRCIGISNRDFVEGVSGATWVDVVLEHGSCVTTMAKNKPTLDIELLKTEVTNPATLRKYCIEAKISNTTTDSRCPTQGEATLVEEQDQNYVCKHTYVDRGWGNGCGLFGKGSLITCAKFKCVTKLEGKIVQYENLKYSVIITVHTGDQHQVGNDTQGVTVEITPQASTVEAILPEYGALGLECSPRTGLDFNEMILLTMKNKAWMVHGQWFFDLPLPWTSGATTETPTWNRKELLVTFKNAHAKKQEVVVLGSQEGAMHSALAGATEIQMSSGNLLFTGHLKCRLRMDKLQLKGMSYSMCTGKFQIVKEIAETQHGTIVIRVQYEGDGSPCKIPLEIMDLEKRHVLGRLITVNPIVIDKEKPVNIEAEPPFGESYIVVGVGDSALTLHWFRKGSSIGQMFETTMRGAKRMAILGDTAWDFGSVGGVLNSLGKMVHQIFGSVYTTMFG

SEQ ID NO: 28 - protein, 444 aa, Artificial Sequence
  Synthetic polypeptide: 16F12-NPRM
MRCVGVGNGDFVEGLSGATWVDVVLEHGSCVTTMAKNKPTLDFELIKTIAKEVALLRTYCIEASISNITTDSRCPTQGEAILPEEQDQNYVCKHTYVDRGWGNGCGLFGKGSVVTCAKFQCLEPIEGKVVQPENLEYTIVITPHTGDQHQVGNDTQGVTVEITPQASTVEAILPEYGTLGLECSPRTGLDFNEMILLTMKNKAWMVHRQWFFDLPLPWTSGATTEVHWNHKERMVTFKTAHAKKQDVVVLGSQEGTMHTALTGATEIQMSSGTTTIFAGHLKCKVKMDKLQLKGMSYTMCTGKFQIVKEIAETQHGTIVIRVQYEGDGAPCKIPLEIMDLEKRHVLGRLITVNPIVIDKEKPVNIEAEPPFGESYIVVGVGDSALKINWYKKGSSIGKMFESTYRGAKRMAILGETAWDFGSVGGVFTSIGKALHQVFGAIYGA

SEQ ID NO: 29 - protein, 447 aa, Artificial Sequence
  Synthetic polypeptide: 16G11-NPRM
MRCVGIGNRDFVEGLSGATWVDVVLEHGGCVTTMAKNKPTLDIELLKTEVTNPAVLRKLCIEASISNTTTDSRCPTQGEATLVEEQDTNFVCRRTFVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWLVHKQWFLDLPLPWTAGADTSEVHWNHKERMVTFKTAHAKKQDVVVLGSQEGAMHTALTGATEIQMSSGNLLFTGHLKCRLRMDKLQLKGMSYVMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFEATARGARRMAILGDTAWDFGSLGGLLTSLGKAVHQVFGSVYTTMFG

SEQ ID NO: 30 - protein, 444 aa, Artificial Sequence
  Synthetic polypeptide: 17A12-NPRM (no prM seq)
MRCVGVGNRDFVEGLSGATWVDVVLEHGSCVTTMAKNKPTLDFELIKTEATQPATLRKYCIEAKITNITTDSRCPTQGEAILPEEQDQNYVCKHTYVDRGWGNGCGLFGKGSLITCAKFKCLEPIEGKVVQPENLEYTIVITPHTGDQHQVGNDTQGVTVEITPQASTVEAILPEYGTLGLECSPRTGLDFNEMILLTMKKKSWLVHKQWFLDLPLPWTSGATTETPTWNRKELLVTFKNAHAKRQDVTVLGSQEGAMHSALTGATEIQTSGTTTIFAGHLKCRVRMDKLQLKGMSYVMCTGSFKLEKEVAETQHGTVLVQVKYEGTDAPCKIPVSSQDEKGVTQNGRLITANPIVTEKDSPVNIEAEPPFGDSYIIIGVEPGQLKLHWFKKGSSIGQMFETTMRGAKRMAILGDTAWDLGSVGGVFTSIGKALHQVFGAIYGA

SEQ ID NO: 31 - protein, 444 aa, Artificial Sequence
  Synthetic polypeptide: 17D5-NPRM (no prM seq)
MRCIGISNRDFVEGVSGATWVDVVLEHGGCVTTMARNKPTLDIELIKTEATQPATLRKYCIEASISNITTATRCPTQGEAILPEEQDQQYICRRDVVDRGWGNGCGLFGKGSVVTCAKFQCLEPIEGKVVQHENLKYTVIITVHTGDQHQVGNDTQGVTVEITPQAPTSEIQLTDYGALTLDCSPRTGLDFNRVVLLTMKKKTWLVHKQWFLDLPLPWTSGATTETPTWNRKELLVTFKNAHAKKQEVVVLGSQEGAMHTALTGATEVDSGDGNLLFTGHLKCRLKMDKLQLKGMSYTMCTGKFQIVKEIAETQHGTILIKVEYKGEDAPCKIPFSTEDEKGVTQNGRLITANPIVTEKDSPVNIEAEPPFGESYIVVGAGDKALKINWYKKGSSIGKMFESTYRGAKRMAILGDTAWDFGSLGGVFTSIGKALHQVFGAIYGA

SEQ ID NO: 32 - protein, 444 aa, Artificial Sequence
  Synthetic polypeptide: 17D11-NPRM (no prM seq)
MRCVGTGNRDFVEGLSGATWVDVVLEHGGCVTTMAQGKPTLDIELIKTEATQPATLRKYCIEAKLTNTTTESRCPTQGEPYLKEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKKKSWLVHKQWFLDLPLPWTAGASTSQETWNRKELLVTFKNAHAKKQEVVVLGSQEGAMHTALTGATEVDSGDGNLLFTGHLKCRLKMDKLQLKGMSYTMCTGKFQIVKEIAETQHGTILIKVEYKGTDAPCKIPFSSQDEKGVTQNGRLITANPIVTEKDSPVNIEAEPPFGESYIVVGAGDKALKINWYKKGSSIGKMFESTYRGAKRMAILGETAWDFGSVGGVFTSIGKALHQVFGAIYGA

SEQ ID NO: 33 - protein, 447 aa, Artificial Sequence
  Synthetic polypeptide: 17F5-NPRM (no prM seq)
MRCVGVGNRDFVEGLSGATWVDVVLEHGSCVTTMAKNKPTLDIELLKTEVTNPATLRKYCIEAKITNITTDSRCPTQGEAILPEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNRVVLLTMKKKSWLVHKQWFLDLPLPWTAGADTSEVHWNHKERMVTFKTAHAKKQDVVVLGSQEGAMHSALAGATEIQMSSGNLLFTGHLKCRLRMDKLQLKGMSYVMCTGKFQIVKEIAETQHGTIVIRVQYEGDDAPCKIPFSTEDEKGVTQNGRLITANPIVTEKDSPVNIEAEPPFGESYIVVGVGDSALTLHWFRKGSSIGQMFETTMRGAKRMAILGDTAWDFGSLGGVFTSLGKAVHQIFGSVYTTMFG

SEQ ID NO: 34 - protein, 447 aa, Artificial Sequence
  Synthetic polypeptide: 17F11-NPRM (no prM seq)
MRCIGISNRDFVEGVSGATWVDVVLEHGGCVTTMAKNKPTLDFELIKTTAKEVALLRTYCIEASISNITTATRCPTQGEAILPEEQDQNYVCKHTYVDRGWGNGCGLFGKGSLITCAKFQCLEPIEGKVVQHENLKYTVIITVHTGDQHQVGNDTQGVTVEITPQASTVEAILPEYGTLGLECSPRTGLDFNEMILLTMKNKAWMVHKQWLLDLPLPWTAGADTSEVHWNHKERMVTFKVPHAKKQDVVVLGSQEGAMHTALTGATEIQMSSGNLLFTGHLKCRLRMDKLQLKGMSYSMCTGKFQIVKEIAETQHGTILIKVEYKGEDAPCKIPFSTEDEKGVTHNGRLITANPIVIDKEKPVNIELEPPFGDSYIVIGVGDSALTLHWFRKGSSIGKMFESTYRGAKRMAILGETAWDFGSVGGLLTSLGKAVHQVFGSVYTTMFG

SEQ ID NO: 35 - protein, 444 aa, Artificial Sequence
  Synthetic polypeptide: 17G5-NPRM (no prM seq)
MRCVGIGNRDFVEGLSGATWVDVVLEHGGCVTTMAKNKPTLDFELIKTTAKEVALLRTYCIEASISNITTATRCPTQGEAILKEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKTAHAKKQEVVVLGSQEGAMHSALAGATEVDSGDGNHMFAGHLKCKVRMDKLTLKGVSYVMCTGSFKLEKEIAETQHGTILIKVEYKGEDAPCKIPFSTEDGQGKAHNGRLITANPIVIDKEKPVNIELEPPFGDSYIVVGAGDKALKINWYKKGSSIGKMFESTYRGAKRMAILGETAWDFGSVGGVFTSIGKALHQVFGAIYGA

SEQ ID NO: 36 - protein, 432 aa, Artificial Sequence
  Synthetic polypeptide: 17H3-NPRM (no prM seq)
MRCIGISNRDFVEGVSGATWVDVVLEHGSCVTTMAKNKPTLDIELLKTEVTNPATLRKYCIEAKITNITTATRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKKKTWMVHRQWFFDLPLPWTAGADTSEVHWNHKERMVTFKTAHAKRQDVTVLGSQEGAMHSALTGATEVDSGDGNLLFTGHLKCRLKMDKLQLKGMSYTMCTGKFQIVKEIAETQHGTILIKVEYKGEDAPCKIPFSTEDGQGKAHNGRLITANPAVTDKEKPVNIELEPPFGDSYIVVGAGDKALKLSWFKKGSSIGQMFESTYRGAKRMAILGETAWDLGSIGGVFTSVGK

SEQ ID NO: 37 - protein, 447 aa, Artificial Sequence
  Synthetic polypeptide: 17H10-NPRM (no prM seq)
MRCIGISNRDFVEGVSGGSWVDVVLEHGSCVTTMAKNKPTLDIELLKTEVTNPATLRKYCIEAKITNITTDSRCPTQGEAIMPEEQDQNYVCKHTYVDRGWGNGCGLFGKGSLVTCAKFTCKKNMEGKVVQHENLKYTVIITVHTGDQHQVGNDTQGVTVEITPQASTVEAILPEYGTLGLECSPRTGLDFNEMILLTMKNKAWMVHRQWFLDLPLPWTAGADTSEVHWNHKERMVTFKTAHAKKQDVVVLGSQEGAMHTALTGATEVDSGDGNLLFTGHLKCRLKMDKLQLKGMSYVMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFEATARGARRMAILGDTAWDFGSVGGVLTSLGKMVHQIFGSVYTTMFG

SEQ ID NO: 38 - protein, 449 aa, Artificial Sequence
  Synthetic polypeptide: 17H12-NPRM (no prM seq)
MRCVGVGNRDFVEGLSGATWVDVVLEHGSCVTTMAQGKPTLDIELLKTEVTNPATLRKYCIEAKLTNTTTESRCPTQGEPYLKEEQDQQYICRRDVVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKSWLVHKQWFLDLPLPWTAGADTSEVHWNHKERMVTFKTAHAKKQDVVVLGSQEGAMHTALTGATEVDSGDGNLLFTGHLKCRLKMDKLQLKGMSYSMCTGKFQIVKEIAETQHGTIVIKVEYKGEDAPCKIPFSTEDGQGKAHNGRLITANPIVIDKEKPVNIEAEPPFGESYIVVGAGEKALKLSWFKKGSSIGQMFETTMRGAKRMAILGDTAWDFGSVGGLLTSLGKMVHQIFGSVYTTMFG

SEQ ID NO: 39 - protein, 447 aa, Artificial Sequence
  Synthetic polypeptide: 18A9-NPRM (no prM seq)
MRCVGIGNRDFVEGLSGATWVDVVLEHGSCVTTMAKNKPTLDIELLKTEVTNPATLRKYCIEAKITNITTATRCPTQGEAILPEEQDQNYVCKHSMVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHKQWFLDLPLPWTAGADTSEVHWNHKERMVTFKVPHAKRQDVTVLGSQEGAMHSALAGATEIQMSSGNLLFTGHLKCRLRMDKLTLKGVSYVMCTGKFQIVKEIAETQHGTIVIRVQYEGTDAPCKIPFSSQDEKGVTQNGRLITANPIVIDKEKPVNIELEPPFGDSYIVVGAGDKALTLHWFRKGSSIGQMFETTMRGAKRMAILGDTAWDFGSVGGLLTSLGKMVHQIFGSVFTSVGK

SEQ ID NO: 40 - protein, 447 aa, Artificial Sequence
  Synthetic polypeptide: 18B7-NPRM (no prM seq)
MRCIGISNRDFVEGLSGATWVDVVLEHGSCVTTMAKNKPTLDFELIKTTAKEVALLRTYCIEASISNITTATRCPTQGEPYLKEEQDQQYICRRDVVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHKQWFLDLPLPWTAGADTSEVHWNHKERMVTFKTAHAKKQDVVVLGSQEGAMHTALTGATEVDSGDGNLLFTGHLKCRLRMDKLQLKGMSYSMCTGKFQIVKEIAETQHGTILIKVEYKGEDAPCKIPFSTEDEKGVTQNGRLITANPIVIDKEKPVNIEAEPPFGDSYIVVGAGDKALKINWYKKGSSIGKMFESTYRGAKRMAILGETAWDFGSVGGLLTSLGKAVHQVFGSVYTTMFG

SEQ ID NO: 41 - protein, 448 aa, Artificial Sequence
  Synthetic polypeptide: 18D7-NPRM (no prM seq)
MRCIGISNRDFVEGVSGATWVDVVLEHGSCVTTMAKNKPTLDIELLKTEVTNPAVLRKLCIEASISNITTATRCPTQGEAILPEEQDQNYVCKHTYVDRGWGNGCGLFGKGSLITCAKFKCVTKLEGKIVQYENLKYSVIVTVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKTAHAKKQDVVVLGSQEGAMHTALTGATEIQMSSGTTTIFAGHLKCRLKMDKLQLKGMSYSMCTGKFQIVKEIAETQHGTILIKVKYEGTDAPCKIPFSSQDEKGVTQNGRLITANPIVTEKDSPVNIEAEPPFGESYIVVGAGEKALKLSWFKKGSSIGQMFESTYRGAKRMAILGETAWDFGSVGGLLTSLGKAVHQVFGSVYTTMFG

SEQ ID NO: 42 - protein, 447 aa, Artificial Sequence
  Synthetic polypeptide: 18E9-NPRM (no prM seq)
MRCVGVGNRDFVEGLSGATWVDVVLEHGGCVTTMAKNKPTLDFELIKTEATQPATLRKYCIEAKLTNTTTATRCPTQGEPYLKEEQDQNYVCKHTYVDRGWGNGCGLFGKGSVVTCAKFQCLEPIEGKVVQHENLKYSVIVTVHTGDQHQVGNDTQGVTVEITPQASTVEAILPEYGTLGLECSPRTGLDFNEMILLTMKKKSWLVHKQWFLDLPLPWTSGASTSQETWNRKELLVTFKNAHAKRQDVTVLGSQEGAMHTALTGATEVDSGDGNLLFTGHLKCRLKMDKLQLKGMSYTMCTGKFQIVKEIAETQHGTILIKVEYKGEDAPCKIPFSSQDEKGVTQNGRLITANPIVIDKEKPVNIELEPPFGDSYIVVGAGDKALKINWYKKGSSIGKMFESTYRGAKRMAILGDTAWDFGSVGGVLNSLGKMVHQIFGSVYTTMFG

SEQ ID NO: 43 - protein, 449 aa, Artificial Sequence
  Synthetic polypeptide: 18E10-NPRM (no prM seq)
MRCVGVGNRDFVEGLSGATWVDVVLEHGGCVTTMAKNKPTLDIELQKTEATQLATLRKYCIEAKLTNTTTESRCPTQGEAILPEEQDQNYVCKHTYVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKSWLVHKQWFLDLPLPWTAGADTSEVHWNHKERMVTFKTAHAKKQEVVVLGSQEGAMHTALTGATEVDSGDGNLLFTGHLKCRLRMDKLQLKGMSYSMCTGKFQIVKEIAETQHGTIVIRVQYEGDGSPCKIPLEIMDLEKRHVLGRLITANPIVIDKEKPVNIELEPPFGDSYIVVGAGDKALKINWYKKGSSIGQMFETTMRGAKRMAILGDTAWDFGSVGGLLTSLGKAVHQVFGSVYTTMFG

SEQ ID NO: 44 - protein, 444 aa, Artificial Sequence
  Synthetic polypeptide: 18E11-NPRM (no prM seq)
MRCVGVGNRDFVEGLSGATWVDVVLEHGGCVTTMAKNKPTLDFELIKTTVKEVALLRTYCIEASISNITTATRCPTQGEPYLKEEQDQQYICRRDVVDRGWGNGCGLFGKGSLITCAKFKCVTKLEGNIVQPENLEYTIVITPHTGDQHQVGNDTQGVTVEITPQASTVEAILPEYGTLGLECSPRTGLDFNEMILLTMKKKSWLVHKQWFLDLPLPWTAGADTSEVHWNHKERMVTFKTAHAKKQDVVVLGSQEGAMHTALTGATEVDSGDGNLLFTGHLKCRLKMDKLQLKGMSYSMCTGKFQIVKEIAETQHGTILIKVEYKGEDAPCKIPFSTEDEKGKAHNGRLITANPIVIDKEKPVNIEAEPPFGESYIVVGAGDKALKLSWFKKGSSIGQMFESTYRGAKRMAILGETAWDFGSVGGVFTSIGKALHQVFGAIYGA

SEQ ID NO: 45 - protein, 449 aa, Artificial Sequence
  Synthetic polypeptide: 18H2-NPRM (no prM seq)
MRCVGVGNRDFVEGVSGGAWVDLVLEHGSCVTTMAKNKPTLDIELLKTEVTNPATLRKYCIEAKITNITTDSRCPTQGEAILPEEQDQNYVCKHTYVDRGWGNGCGLFGKGSVVTCAKFQCLEPIEGKVVQHENLKYTVIITVHTGDQHQVGNDTSNHGVTVEITPQASTVEAILPEYGTLGLECSPRTGLDFNRVVLLTMKKKSWLVHKQWFLDLPLPWTAGADTSEVHWNHKERMVTFKVPHAKKQDVVVLGSQEGAMHTALAGATEIQMSSGNLLFTGHLKCRLKMDKLQLKGMSYSMCTGKFQIVKEIAETQHGTIVIRVQYEGDGAPCKIPFSTEDGQGKAHNGRLITANPVVTKKEEPVNIEAEPPFGESNIVIGIGDKALKINWYKKGSSIGKMFETTMRGAKRMAILGDTAWDFGSVGGLLTSLGKMVHQIFGSVYTTMFG

SEQ ID NO: 46 - protein, 444 aa, Artificial Sequence
  Synthetic polypeptide: 18H6-NPRM (no prM seq)
MRCVGVGNRDFVEGLSGATWVDVVLEHGGCVTTMAKNKPTLDFELIKTTAKEVALLRTYCIEASISNITTATRCPTQGEAILPEEQDQNYVCKHTYVDRGWGNGCGLFGKGSLVTCAKFTCKKNMEGNIVQPENLEYTIVITPHTGDQHQVGNDTQGVTVEITPQASTVEAILPEYGTLGLECSPRTGLDFNRVVLLTMKKKSWLVHKQWFLDLPLPWTAGADTSEVHWNHKERMVTFKNAHAKRQDVTVLGSQEGAMHSALAGATEIQMSSGNLLFTGHLKCRLKMDKLQLKGVSYVMCTGSFKLEKEVAETQHGTVLVQVKYEGTDAPCKIPFSTEDGQGKAHNGRLITVNPIVIDKEKPVNIELEPPFGESYIVVGAGEKALKLSWFKKGSSIGKMFEATARGAKRMAILGETAWDFGSVGGLLTSLGKAVHQVFGAIYGA

SEQ ID NO: 47 - protein, 449 aa, Artificial Sequence
  Synthetic polypeptide: 21C1 ETRUNC only (no prM)
MRCIGISNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFKCVTKLEGKIVQYENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMDKLQLKGMSYSMCTGKFQLVKEIAETQHGTIVIRVQYEGDGSPCKIPLEIMDLEKRHVLGRLITVNPIVIDKEKPVNIEAEPPFGDSYIIIGVGDSALTLHWFRKGSSIGKMFESTYRGARRMAILGETAWDFGSVGGLLTSLGKAVHQVFGSVYTTMFG

SEQ ID NO: 48 - protein, 447 aa, Artificial Sequence
  Synthetic polypeptide: 23C12 ETRUNC only (no prM)
MRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFRKGSSIGQMFETTMRGAKRMAILGETAWDFGSVGGLLTSLGKAVHQVFGSVYTTMFG

SEQ ID NO: 49 - protein, 432 aa, Artificial Sequence
  Synthetic polypeptide: 23F5 ETRUNC only (no prM)
MRCVGIGNRDFVEGLSGGAWVDLVLEHGGCVTTMAKNKPTLDFELIKTEATQPATLRKYCIEAKLTNTTTESRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKTWLVHKQWFLDLPLPWTAGADTREVHWNHKERMVTFKVPHAKRQDVTVLGSQEGAMHSALAGATEVDSGDGNHMFAGHLKCRLKMDKLELKGMSYSMCTGKFRIVKEIAETQHGTIVIRVQYEGDGSPCKIPLEIMDLEKRHVLGRLITVNPIVIDKEKPVNIEAEPPFGESYIVVGAGEKALKLSWFKKGSSIGKMFEATARGARRMAILGDTAWDFGSIGGVFTSVGK

SEQ ID NO: 50 - protein, 468 aa, Artificial Sequence
  Synthetic polypeptide: SEQUENCE PATTERN 1
  VARIANT 2: Xaa = V, T, or G
  VARIANT 3: Xaa = V or I
  VARIANT 4: Xaa = I or F
  VARIANT 8: Xaa = L or M
  VARIANT 12: Xaa = A or T
  VARIANT 15: Xaa = Y or M
  VARIANT 16: Xaa = A, T, or G
  VARIANT 22: Xaa = V or I
  VARIANT 31: Xaa = L or V
  VARIANT 34: Xaa = A or G
  VARIANT 35: Xaa = A or T
  VARIANT 39: Xaa = L or V
  VARIANT 45: Xaa = S or G
  VARIANT 59: Xaa = I or F
  VARIANT 62: Xaa = L or I
  VARIANT 65: Xaa = T or E
  VARIANT 66: Xaa = A or V
  VARIANT 67: Xaa = K or T
  VARIANT 68: Xaa = E or N
  VARIANT 69: Xaa = V or P
  VARIANT 71: Xaa = L, V, or T
  VARIANT 74: Xaa = K or T
  VARIANT 75: Xaa = L or Y
  VARIANT 80: Xaa = K or S
  VARIANT 82: Xaa = T or S
  VARIANT 84: Xaa = I or T
  VARIANT 87: Xaa = A or D
  VARIANT 88: Xaa = T or S
  VARIANT 96: Xaa = A or P
  VARIANT 97: Xaa = I, T, or Y
  VARIANT 99: Xaa = K or V P
  VARIANT 104: Xaa = T or Q
  VARIANT 105: Xaa = Q or N
  VARIANT 106: Xaa = F or Y
  VARIANT 107: Xaa = V or I
  VARIANT 109: Xaa = K or R
  VARIANT 110: Xaa = H or R
  VARIANT 111: Xaa = T or D
  VARIANT 112: Xaa = V or F Y
  VARIANT 129: Xaa = L or V
  VARIANT 130: Xaa = V or I
  VARIANT 136: Xaa = K, T, or Q
  VARIANT 138: Xaa = L, V, or K
  VARIANT 139: Xaa = K, T, or E
  VARIANT 140: Xaa = K, P, or N
  VARIANT 141: Xaa = L, I, or M
  VARIANT 144: Xaa = K or N
  VARIANT 145: Xaa = V or I
  VARIANT 148: Xaa = H or P
  VARIANT 152: Xaa = K or E
  VARIANT 155: Xaa = V or I
  VARIANT 156: Xaa = V or I
  VARIANT 159: Xaa = V or P
  VARIANT 161: Xaa = T or S
  VARIANT 163: Xaa = E or D
  VARIANT 164: Xaa = Q or E
  VARIANT 166: Xaa = A or Q
  VARIANT 172: Xaa = S or G or deleted
  VARIANT 173: Xaa = K or N or deleted
  VARIANT 174: Xaa = H or Q
  VARIANT 176: Xaa = V or K
  VARIANT 177: Xaa = T or E
  VARIANT 178: Xaa = V or I
  VARIANT 179: Xaa = K or E
  VARIANT 184: Xaa = A or S
  VARIANT 186: Xaa = T or I
  VARIANT 187: Xaa = V or T
  VARIANT 190: Xaa = I or E
  VARIANT 192: Xaa = T or P
  VARIANT 193: Xaa = G or E
  VARIANT 197: Xaa = L or V
  VARIANT 198: Xaa = T or G
  VARIANT 199: Xaa = L or M
  VARIANT 211: Xaa = R or E
  VARIANT 212: Xaa = V or M
  VARIANT 213: Xaa = V or I
  VARIANT 219: Xaa = K or N
  VARIANT 221: Xaa = A, T, or S
  VARIANT 223: Xaa = L or M
  VARIANT 226: Xaa = K or R
  VARIANT 230: Xaa = L or F
  VARIANT 238: Xaa = A or S
  VARIANT 241: Xaa = T or D
  VARIANT 243: Xaa = S or E
  VARIANT 244: Xaa = T or E
  VARIANT 245: Xaa = V or P
  VARIANT 246: Xaa = T or H
  VARIANT 249: Xaa = H or R
  VARIANT 252: Xaa = L or R
  VARIANT 253: Xaa = L or M
  VARIANT 258: Xaa = V or T N
  VARIANT 259: Xaa = A or P
  VARIANT 263: Xaa = K or R
  VARIANT 265: Xaa = E or D
  VARIANT 267: Xaa = V or T
  VARIANT 278: Xaa = T or S
  VARIANT 281: Xaa = A or T
  VARIANT 286: Xaa = V or I
  VARIANT 287: Xaa = Q or D
  VARIANT 288: Xaa = S or M
  VARIANT 289: Xaa = S or G
  VARIANT 290: Xaa = S or D
  VARIANT 292: Xaa = T or N
  VARIANT 293: Xaa = T or deleted
  VARIANT 294: Xaa = L or T
  VARIANT 295: Xaa = L or I
  VARIANT 297: Xaa = A or T
  VARIANT 303: Xaa = K or R
  VARIANT 304: Xaa = L or V
  VARIANT 305: Xaa = K or R
  VARIANT 310: Xaa = T or Q
  VARIANT 314: Xaa = V or M
  VARIANT 317: Xaa = V, T, or S
  VARIANT 322: Xaa = K or S
  VARIANT 324: Xaa = K or Q
  VARIANT 325: Xaa = L or I
  VARIANT 326: Xaa = V or E
  VARIANT 329: Xaa = V or I
  VARIANT 338: Xaa = V or I
  VARIANT 339: Xaa = L or V
  VARIANT 340: Xaa = V or I
  VARIANT 341: Xaa = K, R, or Q
  VARIANT 343: Xaa = K, Q, or E
  VARIANT 345: Xaa = K or E
  VARIANT 347: Xaa = T, E, or D
  VARIANT 348: Xaa = G or D
  VARIANT 349: Xaa = A or S
  VARIANT 355: Xaa = L or F
  VARIANT 356: Xaa = S or E
  VARIANT 357: Xaa = T, I, or S
  VARIANT 358: Xaa = Q, E, or M
  VARIANT 360: Xaa = L, G, or E
  VARIANT 361: Xaa = K, Q, or E
  VARIANT 362: Xaa = K or G
  VARIANT 363: Xaa = V, K, or R
  VARIANT 364: Xaa = A, T, or H
  VARIANT 365: Xaa = V, H, or Q
  VARIANT 366: Xaa = L or N
  VARIANT 372: Xaa = A or V
  VARIANT 375: Xaa = V or I
  VARIANT 377: Xaa = T or I
  VARIANT 378: Xaa = K, E, or D
  VARIANT 380: Xaa = E or D
  VARIANT 381: Xaa = K, S, or E
  VARIANT 387: Xaa = A or L
  VARIANT 393: Xaa = E or D
  VARIANT 395: Xaa = Y or N
  VARIANT 397: Xaa = V or I
  VARIANT 398: Xaa = V or I
  VARIANT 400: Xaa = A, V, or I
  VARIANT 401: Xaa = G or E
  VARIANT 402: Xaa = E, P, or D
  VARIANT 403: Xaa = K, S, or G
  VARIANT 404: Xaa = A or Q
  VARIANT 406: Xaa = K or T
  VARIANT 407: Xaa = L or I
  VARIANT 408: Xaa = S, H, or N
  VARIANT 410: Xaa = F or Y
  VARIANT 411: Xaa = K or R
  VARIANT 418: Xaa = K or Q
  VARIANT 422: Xaa = A, T, or S
  VARIANT 424: Xaa = A, Y, or M
  VARIANT 428: Xaa = K or R
  VARIANT 436: Xaa = E or D
  VARIANT 444: Xaa = L or V
  VARIANT 447: Xaa = L or V
  VARIANT 448: Xaa = L or F
  VARIANT 451: Xaa = L or I
  VARIANT 454: Xaa = A or M
  VARIANT 455: Xaa = L or V
  VARIANT 458: Xaa = V or I
  VARIANT 461: Xaa = A or S
  VARIANT 462: Xaa = V or I
  VARIANT 464: Xaa = T or G
  VARIANT 465: Xaa = A or T
  VARIANT 466: Xaa = M or deleted
  VARIANT 467: Xaa = F or deleted
  VARIANT 468: Xaa = G or deleted
MXXXFILXMLVXPSXXMRCVGXGNRDFVEGXSGXXWVDXVLEHGXCVTTMAKNKPTLDXELXKTXXXXXAXLRXXCIEAXIXNXTTXXRCPTQGEXXLXEEQDXXXXCXXXXVDRGWGNGCGLFGKGSXXTCAKFXCXXXXEGXXVQXENLXYTXXITXHXGXXHXVGNDTXXXGXXXXITPQXSXXEAXLXXYGTXXXECSPRTGLDFNXXXLLTMKXKXWXVHXQWFXDLPLPWTXGAXTXXXXWNXKEXXVTFKXXHAKXQXVXVLGSQEGAMHXALXGATEXXXXXGXXXXFXGHLKCXXXMDKLXLKGXSYXMCTGXFXXXKEXANETQHGTXXXXVXYXGXXXPCKIPXXXXDXXXXXXXGRLITXNPXVXXKXXPVNIEXEPPFGXSXIXXGXXXXXLXXXWXXKGSSIGXMFEXTXRGAXRMANILGXTAWDFGSXGGXXTSXGKXXHQXFGXXYXXXXX

SEQ ID NO: 51 - protein, 468 aa, Artificial Sequence
  Synthetic polypeptide: SEQUENCE PATTERN 2
  VARIANT 2: Xaa = A, V, T, or G
  VARIANT 3: Xaa = V or I
  VARIANT 4: Xaa = I or F
  VARIANT 8: Xaa = L or M
  VARIANT 12: Xaa = A or T
  VARIANT 15: Xaa = Y or M
  VARIANT 16: Xaa = A, T, or G
  VARIANT 20: Xaa = V or I
  VARIANT 22: Xaa = V, I, or T
  VARIANT 23: Xaa = S or G
  VARIANT 25: Xaa = R or G
  VARIANT 31: Xaa = L or V
  VARIANT 34: Xaa = A or G
  VARIANT 35: Xaa = A, T, or S
  VARIANT 39: Xaa = L or V
  VARIANT 45: Xaa = S or G
  VARIANT 52: Xaa = K, R, or Q
  VARIANT 53: Xaa = G or N
  VARIANT 59: Xaa = I or F
  VARIANT 62: Xaa = L, I, or Q
  VARIANT 65: Xaa = T, I, or E
  VARIANT 66: Xaa = A or V
  VARIANT 67: Xaa = K or T
  VARIANT 68: Xaa = Q, E, or N
  VARIANT 69: Xaa = L, V, or P
  VARIANT 71: Xaa = L, V, or T
  VARIANT 74: Xaa = K or T
  VARIANT 75: Xaa = L or Y
  VARIANT 80: Xaa = K or S
  VARIANT 81: Xaa = L or I
  VARIANT 82: Xaa = T or S
  VARIANT 84: Xaa = I or T
  VARIANT 87: Xaa = A, E or D
  VARIANT 88: Xaa = T or S
  VARIANT 96: Xaa = A or P
  VARIANT 97: Xaa = I, T, Y, or N
  VARIANT 98: Xaa = L or M
  VARIANT 99: Xaa = K, V, or P
  VARIANT 104: Xaa = T or Q
  VARIANT 105: Xaa = Q or N
  VARIANT 106: Xaa = F or Y
  VARIANT 107: Xaa = V or I
  VARIANT 109: Xaa = K or R
  VARIANT 110: Xaa = H or R
  VARIANT 111: Xaa = T, S, or D
  VARIANT 112: Xaa = V, F, Y, or M
  VARIANT 128: Xaa = S or G
  VARIANT 129: Xaa = L, V, or I
  VARIANT 130: Xaa = V or I
  VARIANT 134: Xaa = K or M
  VARIANT 136: Xaa = K, T, or Q
  VARIANT 138: Xaa = L, V, or K
  VARIANT 139: Xaa = K, T, or E
  VARIANT 140: Xaa = K, P, or N
  VARIANT 141: Xaa = L I M
  VARIANT 144: Xaa = K or N
  VARIANT 145: Xaa = V I
  VARIANT 148: Xaa = H, P, or Y
  VARIANT 152: Xaa = K or E
  VARIANT 154: Xaa = T S
  VARIANT 155: Xaa = V I
  VARIANT 156: Xaa = V or I
  VARIANT 157: Xaa = V or I
  VARIANT 159: Xaa = V or P
  VARIANT 161: Xaa = T or S
  VARIANT 163: Xaa = E or D
  VARIANT 164: Xaa = Q or E
  VARIANT 166: Xaa = A or Q
  VARIANT 170: Xaa = E or D
  VARIANT 172: Xaa = T, S, G or deleted
  VARIANT 173: Xaa = K, E, N or deleted
  VARIANT 174: Xaa = H or Q
  VARIANT 176: Xaa = V, K, or T
  VARIANT 177: Xaa = T, I, or E
  VARIANT 178: Xaa = A, V, or I
  VARIANT 179: Xaa = K, T, or E
  VARIANT 184: Xaa = A or S
  VARIANT 185: Xaa = S or P
  VARIANT 186: Xaa = T or I
  VARIANT 187: Xaa = V, T, or S
  VARIANT 189: Xaa = A or I
  VARIANT 190: Xaa = I, Q, or E
  VARIANT 192: Xaa = T or P
  VARIANT 193: Xaa = G, E, or D
  VARIANT 196: Xaa = A or T
  VARIANT 197: Xaa = L or V
  VARIANT 198: Xaa = T or G
  VARIANT 199: Xaa = L or M
  VARIANT 200: Xaa = E or D
  VARIANT 211: Xaa = R or E
  VARIANT 212: Xaa = V or M
  VARIANT 213: Xaa = V or I
  VARIANT 215: Xaa = L or M
  VARIANT 216: Xaa = K or T
  VARIANT 219: Xaa = K, S, or N
  VARIANT 221: Xaa = A, T, or S
  VARIANT 223: Xaa = L or M
  VARIANT 226: Xaa = K, R, or G
  VARIANT 229: Xaa = L or F
  VARIANT 230: Xaa = L or F
  VARIANT 238: Xaa = A or S
  VARIANT 241: Xaa = T, S, or D
  VARIANT 243: Xaa = S or E
  VARIANT 244: Xaa = V, T, Q, or E
  VARIANT 245: Xaa = V, H, E, or P
  VARIANT 246: Xaa = T or H or deleted
  VARIANT 249: Xaa = H or R
  VARIANT 252: Xaa = L or R
  VARIANT 253: Xaa = L or M
  VARIANT 258: Xaa = V, T, or N
  VARIANT 259: Xaa = A or P
  VARIANT 263: Xaa = K or R
  VARIANT 265: Xaa = E or D
  VARIANT 267: Xaa = V or T
  VARIANT 275: Xaa = A T
  VARIANT 278: Xaa = T S
  VARIANT 281: Xaa = A or T
  VARIANT 283: Xaa = A or T
  VARIANT 286: Xaa = V or I
  VARIANT 287: Xaa = Q or D
  VARIANT 288: Xaa = T, S, N, or M
  VARIANT 289: Xaa = S or G
  VARIANT 290: Xaa = S or D
  VARIANT 292: Xaa = T or N
  VARIANT 294: Xaa = L, T, or H
  VARIANT 295: Xaa = L, I, or M
  VARIANT 297: Xaa = A or T
  VARIANT 299: Xaa = H or R
  VARIANT 303: Xaa = K or R
  VARIANT 304: Xaa = L or V
  VARIANT 305: Xaa = K or R
  VARIANT 307: Xaa = E or D
  VARIANT 310: Xaa = T, R, or Q
  VARIANT 311: Xaa = L or I
  VARIANT 314: Xaa = V or M
  VARIANT 317: Xaa = V, T, or S
  VARIANT 322: Xaa = K or S
  VARIANT 324: Xaa = K or Q
  VARIANT 325: Xaa = L or I
  VARIANT 326: Xaa = V or E
  VARIANT 329: Xaa = V or I
  VARIANT 338: Xaa = V or I
  VARIANT 339: Xaa = L or V
  VARIANT 340: Xaa = V or I
  VARIANT 341: Xaa = K, R, or Q
  VARIANT 343: Xaa = K, Q, or E
  VARIANT 345: Xaa = K or E
  VARIANT 347: Xaa = T, E, or D
  VARIANT 348: Xaa = G or D
  VARIANT 349: Xaa = A or S
  VARIANT 355: Xaa = L, V, or F
  VARIANT 356: Xaa = S or E
  VARIANT 357: Xaa = I, T, or S
  VARIANT 358: Xaa = Q, E, or M
  VARIANT 360: Xaa = L, G, or E
  VARIANT 361: Xaa = K, Q, or E
  VARIANT 362: Xaa = K or G
  VARIANT 363: Xaa = K, V, or R
  VARIANT 364: Xaa = A, T, or H
  VARIANT 365: Xaa = V, H, or Q
  VARIANT 366: Xaa = L or N
  VARIANT 372: Xaa = A or V
  VARIANT 375: Xaa = A, V, or I
  VARIANT 377: Xaa = I or T
  VARIANT 378: Xaa = K, E, or D
  VARIANT 380: Xaa = E or D
  VARIANT 381: Xaa = K, S, or E
  VARIANT 387: Xaa = L or A
  VARIANT 393: Xaa = E or D
  VARIANT 395: Xaa = Y or N
  VARIANT 397: Xaa = V or I
  VARIANT 398: Xaa = V or I
  VARIANT 400: Xaa = A, V, or I
  VARIANT 401: Xaa = G or E
  VARIANT 402: Xaa = E, P, or D
  VARIANT 403: Xaa = K, S, or G
  VARIANT 404: Xaa = A or Q
  VARIANT 406: Xaa = K or T
  VARIANT 407: Xaa = L or I
  VARIANT 408: Xaa = S, H, or N
  VARIANT 410: Xaa = F or Y
  VARIANT 411: Xaa = K or R
  VARIANT 418: Xaa = K or Q
  VARIANT 422: Xaa = A, T, or S
  VARIANT 424: Xaa = A, Y, or M
  VARIANT 428: Xaa = K or R
  VARIANT 436: Xaa = E or D
  VARIANT 441: Xaa = L or F
  VARIANT 444: Xaa = A, L, V, or I
  VARIANT 445: Xaa = G or Y
  VARIANT 446: Xaa = T or G
  VARIANT 447: Xaa = L or V or deleted
  VARIANT 448: Xaa = L or F or deleted
  VARIANT 449: Xaa = T or N or deleted
  VARIANT 450: Xaa = S or deleted
  VARIANT 451: Xaa = L, V, or I or deleted
  VARIANT 452: Xaa = G or deleted
  VARIANT 453: Xaa = K or deleted
  VARIANT 454: Xaa = A or M or deleted
  VARIANT 455: Xaa = L or V or deleted
  VARIANT 456: Xaa = H or deleted
  VARIANT 457: Xaa = Q or deleted
  VARIANT 458: Xaa = V or I or deleted
  VARIANT 459: Xaa = F or deleted
  VARIANT 460: Xaa = G or deleted
  VARIANT 461: Xaa = A or S or deleted
  VARIANT 462: Xaa = V or I or deleted
  VARIANT 463: Xaa = F or Y or deleted
  VARIANT 464: Xaa = T or G or deleted
  VARIANT 465: Xaa = A, T, or S or deleted
  VARIANT 466: Xaa = V or M or deleted
  VARIANT 467: Xaa = G or F or deleted
  VARIANT 468: Xaa = K or G or deleted
MXXXFILXMLVXPSXXMRCXGXXNXDFVEGXSGXXWVDXVLEHGXCVTTMAXXKPTLDXELXKTXXXXXAXLRXXCIEAXXXNXTTXXRCPTQGEXXXXEEQDXXXXCXXXXVDRGWGNGCGLFGKGXXXTCAXFXCXXXXEGXXVQXENLXYXXXXTXHXGXXHXVGNXTXXXGXXXXITPQXXXXEXXLXXYGXXXXXCSPRTGLDFNXXXLXXMKXKXWXVHXQWXXDLPLPWTXGAXTXXXXWNXKEXXVTFKXXHAKXQXVXVLGSQEGXMHXALXGXTEXXXXXGXTXXFXGXLKCXXXMXKLXXKGXSYXMCTGXFXXXKEXANETQHGTXXXXVXYXGXXXPCKIPXXXXDXXXXXXXGRLITXNPXVXXKXXPVNIEXEPPFGXSXIXXGXXXXXLXXXWXXKGSSIGXMFEXTXRGAXRMANILGXTAWDXGSXXXXXXXXXXXXXXXXXXXXXXXXX

SEQ ID NO: 52 - protein, 16 aa, Dengue virus type 1
  DEN-1 PRM15
MGIIFILLMLVTPSMA

SEQ ID NO: 53 - protein, 16 aa, Dengue virus type 2
  DEN-2 PRM15
MGLILILQTAVAPSMT

SEQ ID NO: 54 - protein, 16 aa, Dengue virus type 3
  DEN-3 PRM15
MVVIFILLMLVTPSMT

SEQ ID NO: 55 - protein, 16 aa, Dengue virus type 4
  DEN-4 PRM15
MTVFFILMMLVAPSYG

SEQ ID NO: 56 - protein, 16 aa, Artificial Sequence
  Synthetic polypeptide: 6C6 PRM15
MTVFFILMMLVTPSMA

SEQ ID NO: 57 - protein, 16 aa, Artificial Sequence
  Synthetic polypeptide: PRM15 6F4
MAVFFILLMLVTPSMT

SEQ ID NO: 58 - protein, 16 aa, Artificial Sequence
  Synthetic polypeptide:  PRM15 7A9
MTVFFILMMLVAPSYA

SEQ ID NO: 59 - protein, 16 aa, Artificial Sequence
  Synthetic polypeptide:  PRM15 11E2
MTVFFILLMLVAPSYG

SEQ ID NO: 60 - protein, 16 aa, Artificial Sequence
  Synthetic polypeptide:  PRM15 12E3
MAVFFILMMLVAPSYG

SEQ ID NO: 61 - protein, 16 aa, Artificial Sequence
  Synthetic polypeptide:  PRM15 15C2
MGIIFILLMLVTPSYG

SEQ ID NO: 62 - protein, 16 aa, Artificial Sequence
  Synthetic polypeptide:  PRM15 17A12
MTVFFILMMLVTPSMT

SEQ ID NO: 63 - protein, 16 aa, Artificial Sequence
  Synthetic polypeptide:  PRM15 17D5
MTVFFILLMLVTPSMT

SEQ ID NO: 64 - protein, 16 aa, Artificial Sequence
  Synthetic polypeptide:  PRM15 17G5
MTVFFILMMLVAPSMA

SEQ ID NO: 65 - protein, 462 aa, Artificial Sequence
  Synthetic polypeptide:  2/7
MVVIFILLMLVTPSMTMRCIGISNRDFVEGVSGATWVDVVLEHGSCVTTMAKNKPTLDIELIKTEATQPATLRKYCIEAKLTNTTTESRCPTQGEPYLKEEQDQNYVCKHTYVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKTWLVHKQWFLDLPLPWTAGASTSQETWNRKELLVTFKNAHAKKQEVVVLGSQEGAMHTALTGATEVDSGDGNLLFTGHLKCRLKMDKLQLKGMSYSMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFESTYRGAKRMAILGETAWDFGSVGGVFTSIGKALHQVFGAIYGA

SEQ ID NO: 66 - protein, 463 aa, Artificial Sequence
  Synthetic polypeptide:  2G11
MTVFFILLMLVTPSMAMRCVGIGNRDFVEGLSGATWVDVVLEHGGCVTTMAKNKPTLDFELIKTTAKEVALLRTYCIEASISNITTATRCPTQGEPYLKEEQDQQYICRRDVVDRGWGNGCGLFGKGSLITCAKFKCVTKLEGNIVQPENLEYTIVITPHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHSALAGATEIQMSSGNLLFTGHLKCRLKMDKLQLKGMSYTMCTGKFQIVKEIAETQHGTILIKVEYKGEDAPCKIPFSTEDEKGVTQNGRLITANPIVTEKDSPVNIEAEPPFGESYIVVGAGEKALKLSWFKKGSSIGQMFESTYRGAKRMAILGETAWDFGSVGGLLTSLGKAVHQVFGSVYTTMFG

SEQ ID NO: 67 - protein, 462 aa, Artificial Sequence
  Synthetic polypeptide:  5/21
MTVFFILMMLVAPSYGMRCVGVGNRDFVEGLSGATWVDVVLEHGSCVTTMAKNKPTLDIELLKTEVTNPATLRKYCIEAKITNITTDSRCPTQGEAILPEEQDQNYVCKHTYVDRGWGNGCGLFGKGSLVTCAKFTCKKNMEGNIVQPENLEYTIVITPHSGEEHAVGNDTGKHGKEIKITPQSSITEAELTGYGTVTMECSPRTGLDFNRVVLLTMKKKSWLVHKQWFLDLPLPWTAGADTSEVHWNHKERMVTFKVPHAKRQDVTVLGSQEGAMHSALAGATEIQMSSGNLLFTGHLKCRLRMDKLQLKGMSYVMCTGKFQIVKEIAETQHGTIVIRVQYEGDGSPCKIPLEIMDLEKRHVLGRLITVNPIVIDKEKPVNIEAEPPFGESYIVVGVGDSALTLHWFRKGSSIGQMFETTMRGAKRMAILGDTAWDFGSLGGVFTSIGKALHQVFGAIYGA

SEQ ID NO: 68 - protein, 443 aa, Artificial Sequence
  Synthetic polypeptide:  6C6
MTVFFILMMLVTPSMAMRCVGIGNRDFVEGVSGGAWVDLVLEHGGCVTTMAKNKPTLDFELIKTTAKEVALLRTYCIEASISNITTATRCPTQGEPYLKEEQDQQYICRRDVVDRGWGNGCGLFGKGGIVTCAMFTCKKNMEGNIVQPENLEYTIVITPHSGEEHAVGNDTGKHGKEIKITPQSSITEAELTGYGTVTMECSPRTGLDFNEMILMKMKNKAWMVHRQWFLDLPLPWTAGADTETPTWNRKELLVTFKNAHAKKQEVVVLGSQEGAMHSALAGATEVDSGDGNHMFAGHLKCKVRMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFKKGSSIGKMFEATARGARRMAILGDTAWDFGSAYT

SEQ ID NO: 69 - protein, 464 aa, Artificial Sequence
  Synthetic polypeptide:  6E12
MTVFFILMMLVAPSYGMRCVGVGNRDFVEGLSGATWVDVVLEHGSCVTTMAKNKPTLDIELLKTEVTNPAVLRKLCIEASISNITTATRCPTQGEAILPEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKTAHAKKQDVVVLGSQEGAMHTALTGATEIQMSSGTTTIFAGHLKCKVRMDKLTLKGVSYVMCTGSFKLEKEVAETQHGTVLVQVKYEGTDAPCKIPFSSQDEKGVTQNGRLITANPIVIDKEKPVNIEAEPPFGDSYIIIGVEPGQLKLHWFKKGSSIGQMFETTMRGAKRMAILGDTAWDFGSVGGLLTSLGKMVHQIFGSVYTTMFG

SEQ ID NO: 70 - protein, 460 aa, Artificial Sequence
  Synthetic polypeptide:  6F4
MAVFFILLMLVTPSMTMRCVGIGNRDFVEGVSGGAWVDLVLEHGGCVTTMAKNKPTLDFELIKTEATQPATLRKYCIEAKLTNTTTESRCPTQGEAILPEEQDQQYICRRDVVDRGWGNGCGLFGKGSLITCAKFQCLEPIEGKVVQHENLKYTVIITVHTGDQHQVGNDTQGVTVEITPQASTVEAILPEYGTLGLECSPRTGLDFNEMILLTMKKKSWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFKKGSSIGQMFEATARGARRMAILGDTAWDFGSVGGVFTSIGKALHQVFGAIYGA

SEQ ID NO: 71 - protein, 464 aa, Artificial Sequence
  Synthetic polypeptide:  7A9
MTVFFILMMLVAPSYAMRCVGIGNRDFVEGVSGATWVDVVLEHGGCVTTMAKNKPTLDIELQKTEATQLATLRKLCIEASISNITTATRCPTQGEATLVEEQDTNFVCRRTFVDRGWGNGCGLFGKGSLVTCAKFQCLEPIEGKVVQHENLKYTIVITPHSGEEHAVGNDTGKHGKEIKITPQSSITEAELTGYGTVTMECSPRTGLDFNEMILLTMKSKTWLVHKQWFLDLPLPWTAGADTSEVHWNHKERMVTFKNAHAKKQEVVVLGSQEGAMHTALTGTTEIQNSGNLLFTGHLKCRLRMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFRKGSSIGKMFESTYRGAKRMAILGETAWDFGSVGGLLTSLGKAVHQVFGSVYTTMFG

SEQ ID NO: 72 - protein, 460 aa, Artificial Sequence
  Synthetic polypeptide:  11B1
MVVIFILLMLVTPSMTMRCIGISNRDFVEGVSGATWVDVVLEHGSCVTTMAKNKPTLDIELIKTEATQPATLRKYCIEAKLTNTTTATRCPTQGEAILPEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNHKERMVTFKVPHAKRQDVTVLGSQEGAMHTALTGATEVDSGDGNHMFAGHLKCRLKMDKLQLKGMSYSMCTGKFQIVKEIAETQHGTIVIRVQYEGDGSPCKIPLEIMDLEKRHVLGRLITANPIVTEKDSPVNIEAEPPFGDSYIIIGVEPGQLKLHWFRKGSSIGQMFESTYRGAKRMAILGETAWDFGSVGGLLTSLGKAVHQVFGAIYGA

SEQ ID NO: 73 - protein, 463 aa, Artificial Sequence
  Synthetic polypeptide:  11B8
MTVFFILLMLVAPSYGMRCVGVGNRDFVEGLSGATWVDVVLEHGSCVTTMAKNKPTLDIELLKTEVTNPATLRKYCIEAKLTNTTTESRCPTQGEPYLKEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNRVVLLTMKKKTWLVHKQWFLDLPLPWTAGADTETPTWNRKELLVTFKNAHAKKQEVVVLGSQEGAMHSALAGATEIQMSSGNHMFAGHLKCKVRMEKLQLKGMSYVMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGQMFEATARGARRMAILGDTAWDFGSVGGLLTSLGKMVHQIFGSVYTTMFG

SEQ ID NO: 74 - protein, 443 aa, Artificial Sequence
  Synthetic polypeptide:  11C4
MTVFFILMMLVAPSYGMRCVGIGNRDFVEGLSGATWVDVVLEHGSCVTTMAKNKPTLDIELLKTEVTNPATLRTYCIEASISNITTESRCPTQGEPYLKEEQDQNYVCKHTYVDRGWGNGCGLFGKGSVVTCAKFQCLEPIEGKVVQHENLKYTIVITPHSGEEHAVGNDTGKHGKEIKITPQSSITEAELTGYGTVTMECSPRTGLDFNEMILLTMKSKTWLVHKQWFLDLPLPWTAGADTSQETWNRKELLVTFKNAHAKKQEVVVLGSQEGAMHTALTGATEVDSGDGNLLFTGHLKCRLKMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVGDKALKLHWFKKGSSIGKMFEATARGAKRMAILGETAWDFGSAYT

SEQ ID NO: 75 - protein, 460 aa, Artificial Sequence
  Synthetic polypeptide:  11C11
MTVFFILMMLVAPSYGMRCVGVGNRDFVEGLSGATWVDVVLEHGSCVTTMAKNKPTLDIELLKTEVTNPAVLRKLCIEASISNITTESRCPTQGEPYLKEEQDQNYVCKHTYVDRGWGNGCGLFGKGSLITCAKFKCVTKLEGKIVQYENLKYSVIVTVHTGDQHQVGNETQGVTVEITPQASTVEAILPEYGTLGLECSPRTGLDFNEMILLTMKKKTWLVHKQWFLDLPLPWTAGADTSQETWNRKELLVTFKNAHAKKQEVVVLGSQEGAMHTALTGATEVDSGDGNLLFTGHLKCRLKMDKLQLKGMSYSMCTGKFQIVKEIAETQHGTIVIRVQYEGEDAPCKIPFSTEDGQGKAHNGRLITANPIVTEKDSPVNIEAEPPFGDSYIVVGAGEKALKLHWFKKGSSIGQMFEATARGARRMAILGDTAWDFGSVGGVFTSIGKALHQVFGAIYGA

SEQ ID NO: 76 - protein, 462 aa, Artificial Sequence
  Synthetic polypeptide:  11E2
MTVFFILLMLVAPSYGMRCVGVGNRDFVEGLSGATWVDVVLEHGSCVTTMAKNKPTLDIELLKTEVTNPAVLRKLCIEASISNITTATRCPTQGEAILPEEQDQNYVCKHTYVDRGWGNGCGLFGKGSLVTCAKFKCVTKLEGKIVQYENLKYSVIVTVHTGDQHQVGNETTEHGTIATITPQAPTSEIQLTDYGALTLDCSPRTGLDFNRVVLLTMKKKTWLVHKQWFLDLPLPWTAGASTSQETWNRKELLVTFKNAHAKRQDVTVLGSQEGAMHSALTGATEIQMSSGNLLFAGHLKCRLKMDKLQLKGMSYSMCTGKFQIVKEIAETQHGTIVIRVQYEGDGAPCKIPLEIMDLEKRHVLGRLITVNPIVTEKDSPVNIEAEPPFGESYIVVGVGDSALTLHWFRKGSSIGQMFEATARGAKRMAILGDTAWDFGSVGGVFTSIGKALHQVFGAIYGA

SEQ ID NO: 77 - protein, 465 aa, Artificial Sequence
  Synthetic polypeptide:  12E3
MAVFFILMMLVAPSYGMRCVGVGNRDFVEGLSGATWVDVVLEHGSCVTTMAKNKPTLDIELIKTTAKEVALLRTYCIEASISNITTATRCPTQGEAILPEEQDQNYVCKHTYVDRGWGNGCGLFGKGSLVTCAKFTCKKNMEGNIVQPENLEYTIVITPHSGEEHAVGNDTGKHGKEIKITPQSSITEAELTGYGTVTMECSPRTGLDFNRVVLLTMKKKSWLVHKQWFLDLPLPWTAGASTSQETWNRKELLVTFKNAHAKKQEVVVLGSQEGAMHTALTGATEIQMSSGNLLFTGHLKCRLRMDKLQLKGMSYSMCTGKFQIVKEIAETQHGTIVIRVQYEGDGAPCKIPFSTEDGQGKAHNGRLITANPIVIDKEKPVNIELEPPFGESYIVVGAGDKALKINWYKKGSSIGKMFESTYRGAKRMAILGETAWDFGSVGGLLTSLGKAVHQVFGSVYTTMFG

SEQ ID NO: 78 - protein, 441 aa, Artificial Sequence
  Synthetic polypeptide:  12H4
MTVFFILMMLVAPSYAMRCIGISNRDFVEGVSGATWVDVVLEHGSCVTTMAKNKPTLDIELIKTEATQPATLRKYCIEASISNITTDSRCPTQGEPYLKEEQDQQYICRRDVVDRGWGNGCGLFGKGSLITCAKFKCVTKLEGKIVQYENLKYSVIVTVHTGDQHQVGNDTQGVTVEITPQASTVEAILPEYGTLGLECSPRTGLDFNEMILLTMKKKSWLVHKQWFLDLPLPWTAGADTETPTWNRKELLVTFKNAHAKKQEVVVLGSQEGAMHTALTGATEIQMSSGNLLFTGHLKCRLKMDKLQLKGMSYSMCTGKFQIVKEIAETQHGTIVIRVQYEGDGAPCKIPFSTEDEKGVTQNGRLITANPIVTEKDSPVNIEAEPPFGDSYIIIGVEPGQLKLHWFKKGSSIGQMFEATARGARRMAILGDTAWDFGSAYT

SEQ ID NO: 79 - protein, 465 aa, Artificial Sequence
  Synthetic polypeptide:  13E2
MTVFFILMMLVTPSMAMRCVGIGNRDFVEGVSGATWVDVVLEHGGCVTTMAKNKPTLDFELIKTTAKEVALLRTYCIEASISNITTATRCPTQGEPYLKEEQDQQYICRRDVVDRGWGNGCGLFGKGSLITCAKFKCVTKLEGNIVQPENLEYTIVITPHSGEEHAVGNDTGKHGKEIKITPQSSITEAELTGYGTVTMECSPRTGLDFNEMILLTMKKKSWLVHKQWFLDLPLPWTAGASTSQETWNRKELLVTFKNAHAKKQEVVVLGSQEGAMHTALTGATEIQMSSGNLLFTGHLKCRLRMDKLQLKGMSYTMCTGKFQIVKEIAETQHGTIVIRVQYEGTDAPCKIPFSTEDGQGKAHNGRLITANPIVIDKEKPVNIELEPPFGDSYIIIGVEPGQLKLHWFKKGSSIGKMFEATARGAKRMAILGETAWDFGSVGGLLTSLGKMVHQIFGSVYTTMFG

SEQ ID NO: 80 - protein, 462 aa, Artificial Sequence
  Synthetic polypeptide:  13E11
MTVFFILMMLVTPSMAMRCVGVGNRDFVEGVSGGAWVDVVLEHGGCVTTMAKNKPTLDIELIKTEATQPATLRKYCIEASISNITTDTRCPTQGEPYLKEEQDQNYVCKHTYVDRGWGNGCGLFGKGSLITCAKFKCVTKLEGKIVQYENLKYSVIVTVHTGDQHQVGNETTEHGTIATITPQAPTSEIQLTDYGTVTMECSPRTGLDFNEMILLTMKSKTWLVHKQWFLDLPLPWTAGADTETPTWNRKELLVTFKNAHAKKQEVVVLGSQEGAMHTALAGATEIQMSSGNLLFTGHLKCRLKMDKLQLKGMSYTMCTGKFQIVKEIAETQHGTIVIRVQYEGTDAPCKIPFSTEDGQGKAHNGRLITANPIVIDKEKPVNIELEPPFGESYIVVGAGEKALTLHWFRKGSSIGQMFETTMRGAKRMAILGETAWDFGSVGGVFTSIGKALHQVFGAIYGA

SEQ ID NO: 81 - protein, 462 aa, Artificial Sequence
  Synthetic polypeptide:  13F11
MTVFFILMMLVTPSMAMRCVGIGNRDFVEGVSGGAWVDLVLEHGGCVTTMAKNKPTLDIELIKTEATQPATLRKYCIEAKITNITTDSRCPTQGEPYLKEEQDQQYICRRDVVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKTWLVHKQWFLDLPLPWTAGADTSEVHWNHKERMVTFKVPHAKRQDVTVLGSQEGAMHSALAGATEVDSGDGNHMFAGHLKCRLKMDKLQLKGMSYSMCTGKFQIVKEIAETQHGTIVIRVQYEGDGAPCKIPFSTEDEKGKAHNGRLITANPIVIDKEKPVNIELEPPFGESYIVVGAGEKALKLSWFKKGSSIGKMFESTYRGAKRMAILGDTAWDFGSVGGVFTSIGKALHQVFGAIYGA

SEQ ID NO: 82 - protein, 441 aa, Artificial Sequence
  Synthetic polypeptide:  14B1
MTVFFILMMLVAPSYGMRCVGISNRDFVEGVSGGAWVDLVLEHGGCVTTMAKNKPTLDIELLKTEVTNPATLRKYCIEAKITNITTDSRCPTQGEPYLKEEQDQQYICRRDVVDRGWGNGCGLFGKGSLITCAKFKCVTKLEGNIVQPENLKYTIVITPHTGDQHQVGNDTQGVTVEITPQASTVEAILPEYGTLGLECSPRTGLDFNEMILLTMKKKSWLVHKQWFLDLPLPWTAGADTETPTWNRKELLVTFKNAHAKRQDVTVLGSQEGAMHSALTGATEVDSGDGNLLFTGHLKCRLKMDKLQLKGMSYTMCTGKFQIVKEIAETQHGTIVIRVQYEGDGAPCKIPFSTEDEKGVTQNGRLITANPIVTEKDSPVNIEAEPPFGESYIVVGAGEKALKLSWFKKGSSIGQMFESTARGARRMAILGDTAWDFGSAYT

SEQ ID NO: 83 - protein, 441 aa, Artificial Sequence
  Synthetic polypeptide:  14E9
MTVFFILLMLVTPSMAMRCVGIGNRDFVEGVSGGAWVDLVLEHGGCVTTMAKNKPTLDIELIKTEATQPATLRKYCIEAKITNITTDSRCPTQGEAILPEEQDQQYICRRDVVDRGWGNGCGLFGKGSVVTCAKFQCVTKLEGNIVQPENLEYTIVITPHTGDQHQVGNDTQGVTVEITPQASTVEAILPEYGTLGLECSPRTGLDFNEMILMKMKNKAWMVHKQWFLDLPLPWTSGASTSQETWNRKELLVTFKNAHAKKQEVVVLGSQEGAMHSALAGATEIQMSSGNLLFTGHLKCRLKMDKLQLKGMSYTMCTGKFQIVKEIAETQHGTIVIRVQYEGDGSPCKIPLEIMDLEKRHVLGRLITANPIVIDKEKPVNIELEPPFGDSYIVVGAGDKALKINWYKKGSSIGKMFESTYRGAKRMAILGETAWDFGSAYT

SEQ ID NO: 84 - protein, 462 aa, Artificial Sequence
  Synthetic polypeptide:  14G10
MAVFFILLMLVTPSMAMRCIGISNRDFVEGVSGATWVDVVLEHGGCVTTMAKNKPTLDIELLKTEVTNPATLRKYCIEAKITNITTDTRCPTQGEAILPEEQDQQYICRRDVVDRGWGNGCGLFGKGSLVTCAKFTCKKNMEGNIVQPENLEYTIVITPHSGEEHAVGNETTEHGTIATITPQAPTSEIQLTDYGALTLDCSPRTGLDFNRVVLLTMKKKTWLVHKQWFLDLPLPWTAGADTSEVHWNHKERMVTFKVPHAKRQDVTVLGSQEGAMHSALAGATEIQMSSGNLLFTGHLKCRLKMDKLQLKGMSYSMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFESTYRGAKRMAILGETAWDFGSVGGVFTSIGKALHQVFGAIYGA

SEQ ID NO: 85 - protein, 460 aa, Artificial Sequence
  Synthetic polypeptide:  14H2
MTVFFILMMLVAPSYGMRCVGVGNRDFVEGVSGGAWVDLVLEHGGCVTTMAKNKPTLDFELIKTTAKEVALLRTYCIEAKITNITTATRCPTQGEPYLKEEQDQNYVCKHTYVDRGWGNGCGLFGKGSLITCAKFQCVTKLEGNIVQPENLEYTIVITPHSGEEHAVGNDTQGVTVEITPQASTVEAILTDYGALTLDCSPRTGLDFNRVVLLTMKKKTWLVHKQWFLDLPLPWTAGADTSEVHWNHKERMVTFKVPHAKKQEVVVLGSQEGAMHTALTGATEVDSGDGNLLFTGHLKCRLKMDKLQLKGMSYSMCTGKFQIVKEIAETQHGTIVIRVQYKGEDAPCKIPFSSQDGQGKAHNGRLITANPIVTEKDSPVNIEAEPPFGESYIVVGAGEKALKLSWFKKGSSIGQMFETTMRGAKRMAILGETAWDFGSVGGVFTSIGKALHQVFGAIYGA

SEQ ID NO: 86 - protein, 463 aa, Artificial Sequence
  Synthetic polypeptide:  15C2
MVVIFILLMLVTPSMAMRCVGISNRDFVEGLSGATWVDVVLEHGSCVTTMAKNKPTLDIELLKTEVTNPATLRKYCIEAKITNITTDSRCPTQGEPYLKEEQDQQYICRRDVVDRGWGNGCGLFGKGSVVTCAKFQCLEPIEGKIVQYENLKYSVIVTVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKVPHAKRQDVTVLGSQEGAMHSALAGATEVDSGDGNHMFAGHLKCRLKMDKLQLKGMSYVMCTGKFQIVKEIAETQHGTIVIRVQYEGDGAPCKIPFSTEDEKGVTQNGRLITANPIVIDKEKPVNIEAEPPFGESYIVIGVEPGQLKLHWFKKGSSIGQMFEATARGARRMAILGETAWDFGSVGGLLTSLGKAVHQVFGSVYTTMFG

SEQ ID NO: 87 - protein, 462 aa, Artificial Sequence
  Synthetic polypeptide:  15D4
MTVFFILLMLVTPSMAMRCVGIGNRDFVEGLSGATWVDVVLEHGGCVTTMAKNKPTLDFELIKTTAKEVALLRTYCIEAKITNITTDSRCPTQGEAILPEEQDQNYVCKHTYVDRGWGNGCGLFGKGSLITCAKFKCLEPIEGKVVQPENLEYTIVITPHSGEEHAVGNDTGKHGKEIKITPQSSITEAELTGYGTVTMECSPRTGLDFNRVVLLTMKKKSWLVHKQWFLDLPLPWTAGADTSEVHWNHKERMVTFKTAHAKKQDVVVLGSQEGAMHSALAGATEIQMSSGNLLFTGHLKCRLRMDKLTLKGVSYVMCTGSFKLEKEVAETQHGTVLVQVKYEGTDAPCKIPFSTEDEKGVTQNGRLITANPIVTEKDSPVNIEAEPPFGESYIVVGAGDKALKINWYKKGSSIGKMFESTYRGAKRMAILGDTAWDFGSLGGVFTSIGKALHQVFGAIYGA

SEQ ID NO: 88 - protein, 463 aa, Artificial Sequence
  Synthetic polypeptide:  15H4
MTVFFILMMLVAPSYGMRCVGVGNRDFVEGLSGATWVDVVLEHGSCVTTMAKNKPTLDFELIKTEVTNPATLRKYCIEASISNITTATRCPTQGEANLPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNRVVLLTMKKKSWLVHKQWFLDLPLPWTAGADTSEVHWNHKERMVTFKTAHAKKQEVVVLGSQEGAMHSALAGATEIQMSSGNLLFTGRLKCRLKMDKLQLKGMSYVMCTGKFQIVKEIAETQHGTIVIRVQYEGDGAPCKIPLEIMDLEKRHVLGRLITVNPIVIDKEKPVNIEAEPPFGDSYIIIGVEPGQLKLHWFKKGSSIGQMFESTYRGAKRMAILGDTAWDFGSVGGVLNSLGKMVHQIFGSVYTTMFG

SEQ ID NO: 89 - protein, 464 aa, Artificial Sequence
  Synthetic polypeptide:  16B4
MGIIFILLMLVTPSYGMRCVGVGNRDFVEGLSGATWVDVVLEHGSCVTTMAKNKPTLDIELLKTEVTNPAVLRKLCIEASISNITTDSRCPTQGEAILPEEQDQNYVCKHTYVDRGWGNGCGLFGKGSLITCAKFKCLEPIEGKVVQHENLKYTVIITVHTGDQHQVGNDTQGVTVEITPQASTVEAILPEYGTLGLECSPRTGLDFNEMILLTMKKKTWLVHKQWFLDLPLPWTAGADTSEVHWNHKERMVTFKTAHAKKQDVVVLGSQEGAMHTALTGATEIQMSSGTTTIFAGHLKCRLKMDKLQLKGMSYTMCTGKFQIVKEIAETQHGTILIKVEYKGEDAPCKIPFSTEDEKGVTQNGRLITANPIVTEKDSPVNIEAEPPFGESYIVVGVGDKALKINWYKKGSSIGQMFETTMRGAKRMAILGDTAWDFGSVGGLLTSLGKMVHQIFGSVYTTMFG

SEQ ID NO: 90 - protein, 460 aa, Artificial Sequence
  Synthetic polypeptide:  16E8
MTVFFILMMLVAPSYGMRCVGVGNRDFVEGLSGATWVDVVLEHGGCVTTMAKNKPTLDFELIKTTAKEVALLRTYCIEASISNITTATRCPTQGEPYLKEEQDQQYICRRDVVDRGWGNGCGLFGKGSLITCAKFKCVTKLEGNIVQPENLEYTIVITPHTGDQHQVGNDTQGVTVEITPQASTVEAILPEYGTLGLECSPRTGLDFNEMILLTMKNKAWMVHKQWFLDLPLPWTSGATTETPTWNRKELLVTFKTAHAKKQDVVVLGSQEGAMHTALTGATEIQMSSGNLLFTGHLKCRLRMDKLQLKGMSYVMCTGKFQIVKEIAETQHGTILIKVEYKGEDAPCKIPFSTEDGQGKAHNGRLITANPIVIDKEKPVNIEAEPPFGESNIVIGIGDKALKINWYKKGSSIGKMFETTMRGAKRMAILGDTAWDFGSVGGVFTSIGKALHQVFGAIYGA

SEQ ID NO: 91 - protein, 463 aa, Artificial Sequence
  Synthetic polypeptide:  16E10
MTVFFILMMLVAPSYGMRCIGISNRDFVEGVSGATWVDVVLEHGSCVTTMAKNKPTLDIELLKTEVTNPATLRKYCIEAKISNTTTDSRCPTQGEATLVEEQDQNYVCKHTYVDRGWGNGCGLFGKGSLITCAKFKCVTKLEGKIVQYENLKYSVIITVHTGDQHQVGNDTQGVTVEITPQASTVEAILPEYGALGLECSPRTGLDFNEMILLTMKNKAWMVHGQWFFDLPLPWTSGATTETPTWNRKELLVTFKNAHAKKQEVVVLGSQEGAMHSALAGATEIQMSSGNLLFTGHLKCRLRMDKLQLKGMSYSMCTGKFQIVKEIAETQHGTIVIRVQYEGDGSPCKIPLEIMDLEKRHVLGRLITVNPIVIDKEKPVNIEAEPPFGESYIVVGVGDSALTLHWFRKGSSIGQMFETTMRGAKRMAILGDTAWDFGSVGGVLNSLGKMVHQIFGSVYTTMFG

SEQ ID NO: 92 - protein, 460 aa, Artificial Sequence
  Synthetic polypeptide:  16F12
MTVFFILMMLVAPSYGMRCVGVGNGDFVEGLSGATWVDVVLEHGSCVTTMAKNKPTLDFELIKTIAKEVALLRTYCIEASISNITTDSRCPTQGEAILPEEQDQNYVCKHTYVDRGWGNGCGLFGKGSVVTCAKFQCLEPIEGKVVQPENLEYTIVITPHTGDQHQVGNDTQGVTVEITPQASTVEAILPEYGTLGLECSPRTGLDFNEMILLTMKNKAWMVHRQWFFDLPLPWTSGATTEVHWNHKERMVTFKTAHAKKQDVVVLGSQEGTMHTALTGATEIQMSSGTTTIFAGHLKCKVKMDKLQLKGMSYTMCTGKFQIVKEIAETQHGTIVIRVQYEGDGAPCKIPLEIMDLEKRHVLGRLITVNPIVIDKEKPVNIEAEPPFGESYIVVGVGDSALKINWYKKGSSIGKMFESTYRGAKRMAILGETAWDFGSVGGVFTSIGKALHQVFGAIYGA

SEQ ID NO: 93 - protein, 463 aa, Artificial Sequence
  Synthetic polypeptide:  16G11
MGIIFILLMLVTPSMAMRCVGIGNRDFVEGLSGATWVDVVLEHGGCVTTMAKNKPTLDIELLKTEVTNPAVLRKLCIEASISNTTTDSRCPTQGEATLVEEQDTNFVCRRTFVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWLVHKQWFLDLPLPWTAGADTSEVHWNHKERMVTFKTAHAKKQDVVVLGSQEGAMHTALTGATEIQMSSGNLLFTGHLKCRLRMDKLQLKGMSYVMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFEATARGARRMAILGDTAWDFGSLGGLLTSLGKAVHQVFGSVYTTMFG

SEQ ID NO: 94 - protein, 460 aa, Artificial Sequence
  Synthetic polypeptide:  17A12
MTVFFILMMLVTPSMTMRCVGVGNRDFVEGLSGATWVDVVLEHGSCVTTMAKNKPTLDFELIKTEATQPATLRKYCIEAKITNITTDSRCPTQGEAILPEEQDQNYVCKHTYVDRGWGNGCGLFGKGSLITCAKFKCLEPIEGKVVQPENLEYTIVITPHTGDQHQVGNDTQGVTVEITPQASTVEAILPEYGTLGLECSPRTGLDFNEMILLTMKKKSWLVHKQWFLDLPLPWTSGATTETPTWNRKELLVTFKNAHAKRQDVTVLGSQEGAMHSALTGATEIQTSGTTTIFAGHLKCRVRMDKLQLKGMSYVMCTGSFKLEKEVAETQHGTVLVQVKYEGTDAPCKIPVSSQDEKGVTQNGRLITANPIVTEKDSPVNIEAEPPFGDSYIIIGVEPGQLKLHWFKKGSSIGQMFETTMRGAKRMAILGDTAWDLGSVGGVFTSIGKALHQVFGAIYGA

SEQ ID NO: 95 - protein, 460 aa, Artificial Sequence
  Synthetic polypeptide:  17D5
MTVFFILLMLVTPSMTMRCIGISNRDFVEGVSGATWVDVVLEHGGCVTTMARNKPTLDIELIKTEATQPATLRKYCIEASISNITTATRCPTQGEAILPEEQDQQYICRRDVVDRGWGNGCGLFGKGSVVTCAKFQCLEPIEGKVVQHENLKYTVIITVHTGDQHQVGNDTQGVTVEITPQAPTSEIQLTDYGALTLDCSPRTGLDFNRVVLLTMKKKTWLVHKQWFLDLPLPWTSGATTETPTWNRKELLVTFKNAHAKKQEVVVLGSQEGAMHTALTGATEVDSGDGNLLFTGHLKCRLKMDKLQLKGMSYTMCTGKFQIVKEIAETQHGTILIKVEYKGEDAPCKIPFSTEDEKGVTQNGRLITANPIVTEKDSPVNIEAEPPFGESYIVVGAGDKALKINWYKKGSSIGKMFESTYRGAKRMAILGDTAWDFGSLGGVFTSIGKALHQVFGAIYGA

SEQ ID NO: 96 - protein, 460 aa, Artificial Sequence
  Synthetic polypeptide:  17D11
MTVFFILMMLVAPSYGMRCVGTGNRDFVEGLSGATWVDVVLEHGGCVTTMAQGKPTLDIELIKTEATQPATLRKYCIEAKLTNTTTESRCPTQGEPYLKEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKKKSWLVHKQWFLDLPLPWTAGASTSQETWNRKELLVTFKNAHAKKQEVVVLGSQEGAMHTALTGATEVDSGDGNLLFTGHLKCRLKMDKLQLKGMSYTMCTGKFQIVKEIAETQHGTILIKVEYKGTDAPCKIPFSSQDEKGVTQNGRLITANPIVTEKDSPVNIEAEPPFGESYIVVGAGDKALKINWYKKGSSIGKMFESTYRGAKRMAILGETAWDFGSVGGVFTSIGKALHQVFGAIYGA

SEQ ID NO: 97 - protein, 463 aa, Artificial Sequence
  Synthetic polypeptide:  17F5
MTVFFILMMLVAPSYGMRCVGVGNRDFVEGLSGATWVDVVLEHGSCVTTMAKNKPTLDIELLKTEVTNPATLRKYCIEAKITNITTDSRCPTQGEAILPEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNRVVLLTMKKKSWLVHKQWFLDLPLPWTAGADTSEVHWNHKERMVTFKTAHAKKQDVVVLGSQEGAMHSALAGATEIQMSSGNLLFTGHLKCRLRMDKLQLKGMSYVMCTGKFQIVKEIAETQHGTIVIRVQYEGDDAPCKIPFSTEDEKGVTQNGRLITANPIVTEKDSPVNIEAEPPFGESYIVVGVGDSALTLHWFRKGSSIGQMFETTMRGAKRMAILGDTAWDFGSLGGVFTSLGKAVHQIFGSVYTTMFG

SEQ ID NO: 98 - protein, 463 aa, Artificial Sequence
  Synthetic polypeptide:  17F11
MVVIFILLMLVTPSMTMRCIGISNRDFVEGVSGATWVDVVLEHGGCVTTMAKNKPTLDFELIKTTAKEVALLRTYCIEASISNITTATRCPTQGEAILPEEQDQNYVCKHTYVDRGWGNGCGLFGKGSLITCAKFQCLEPIEGKVVQHENLKYTVIITVHTGDQHQVGNDTQGVTVEITPQASTVEAILPEYGTLGLECSPRTGLDFNEMILLTMKNKAWMVHKQWLLDLPLPWTAGADTSEVHWNHKERMVTFKVPHAKKQDVVVLGSQEGAMHTALTGATEIQMSSGNLLFTGHLKCRLRMDKLQLKGMSYSMCTGKFQIVKEIAETQHGTILIKVEYKGEDAPCKIPFSTEDEKGVTHNGRLITANPIVIDKEKPVNIELEPPFGDSYIVIGVGDSALTLHWFRKGSSIGKMFESTYRGAKRMAILGETAWDFGSVGGLLTSLGKAVHQVFGSVYTTMFG

SEQ ID NO: 99 - protein, 460 aa, Artificial Sequence
  Synthetic polypeptide:  17G5
MTVFFILMMLVAPSMAMRCVGIGNRDFVEGLSGATWVDVVLEHGGCVTTMAKNKPTLDFELIKTTAKEVALLRTYCIEASISNITTATRCPTQGEAILKEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKTAHAKKQEVVVLGSQEGAMHSALAGATEVDSGDGNHMFAGHLKCKVRMDKLTLKGVSYVMCTGSFKLEKEIAETQHGTILIKVEYKGEDAPCKIPFSTEDGQGKAHNGRLITANPIVIDKEKPVNIELEPPFGDSYIVVGAGDKALKINWYKKGSSIGKMFESTYRGAKRMAILGETAWDFGSVGGVFTSIGKALHQVFGAIYGA

SEQ ID NO: 100 - protein, 448 aa, Artificial Sequence
  Synthetic polypeptide:  17H3
MVVIFILLMLVTPSMTMRCIGISNRDFVEGVSGATWVDVVLEHGSCVTTMAKNKPTLDIELLKTEVTNPATLRKYCIEAKITNITTATRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKKKTWMVHRQWFFDLPLPWTAGADTSEVHWNHKERMVTFKTAHAKRQDVTVLGSQEGAMHSALTGATEVDSGDGNLLFTGHLKCRLKMDKLQLKGMSYTMCTGKFQIVKEIAETQHGTILIKVEYKGEDAPCKIPFSTEDGQGKAHNGRLITANPAVTDKEKPVNIELEPPFGDSYIVVGAGDKALKLSWFKKGSSIGQMFESTYRGAKRMAILGETAWDLGSIGGVFTSVGK

SEQ ID NO: 101 - protein, 463 aa, Artificial Sequence
  Synthetic polypeptide:  17H10
MVVIFILLMLVTPSMTMRCIGISNRDFVEGVSGGSWVDVVLEHGSCVTTMAKNKPTLDIELLKTEVTNPATLRKYCIEAKITNITTDSRCPTQGEAIMPEEQDQNYVCKHTYVDRGWGNGCGLFGKGSLVTCAKFTCKKNMEGKVVQHENLKYTVIITVHTGDQHQVGNDTQGVTVEITPQASTVEAILPEYGTLGLECSPRTGLDFNEMILLTMKNKAWMVHRQWFLDLPLPWTAGADTSEVHWNHKERMVTFKTAHAKKQDVVVLGSQEGAMHTALTGATEVDSGDGNLLFTGHLKCRLKMDKLQLKGMSYVMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFEATARGARRMAILGDTAWDFGSVGGVLTSLGKMVHQIFGSVYTTMFG

SEQ ID NO: 102 - protein, 465 aa, Artificial Sequence
  Synthetic polypeptide: 17H12
MVVIFILLMLVTPSMTMRCVGVGNRDFVEGLSGATWVDVVLEHGSCVTTMAQGKPTLDIELLKTEVTNPATLRKYCIEAKLTNTTTESRCPTQGEPYLKEEQDQQYICRRDVVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKSWLVHKQWFLDLPLPWTAGADTSEVHWNHKERMVTFKTAHAKKQDVVVLGSQEGAMHTALTGATEVDSGDGNLLFTGHLKCRLKMDKLQLKGMSYSMCTGKFQIVKEIAETQHGTIVIKVEYKGEDAPCKIPFSTEDGQGKAHNGRLITANPIVIDKEKPVNIEAEPPFGESYIVVGAGEKALKLSWFKKGSSIGQMFETTMRGAKRMAILGDTAWDFGSVGGLLTSLGKMVHQIFGSVYTTMFG

SEQ ID NO: 103 - protein, 463 aa, Artificial Sequence
  Synthetic polypeptide:  18A9
MTVFFILLMLVTPSMAMRCVGIGNRDFVEGLSGATWVDVVLEHGSCVTTMAKNKPTLDIELLKTEVTNPATLRKYCIEAKITNITTATRCPTQGEAILPEEQDQNYVCKHSMVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHKQWFLDLPLPWTAGADTSEVHWNHKERMVTFKVPHAKRQDVTVLGSQEGAMHSALAGATEIQMSSGNLLFTGHLKCRLRMDKLTLKGVSYVMCTGKFQIVKEIAETQHGTIVIRVQYEGTDAPCKIPFSSQDEKGVTQNGRLITANPIVIDKEKPVNIELEPPFGDSYIVVGAGDKALTLHWFRKGSSIGQMFETTMRGAKRMAILGDTAWDFGSVGGLLTSLGKMVHQIFGSVFTSVGK

SEQ ID NO: 104 - protein, 463 aa, Artificial Sequence
  Synthetic polypeptide: 18B7
MTVFFILLMLVTPSMAMRCIGISNRDFVEGLSGATWVDVVLEHGSCVTTMAKNKPTLDFELIKTTAKEVALLRTYCIEASISNITTATRCPTQGEPYLKEEQDQQYICRRDVVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHKQWFLDLPLPWTAGADTSEVHWNHKERMVTFKTAHAKKQDVVVLGSQEGAMHTALTGATEVDSGDGNLLFTGHLKCRLRMDKLQLKGMSYSMCTGKFQIVKEIAETQHGTILIKVEYKGEDAPCKIPFSTEDEKGVTQNGRLITANPIVIDKEKPVNIEAEPPFGDSYIVVGAGDKALKINWYKKGSSIGKMFESTYRGAKRMAILGETAWDFGSVGGLLTSLGKAVHQVFGSVYTTMFG

SEQ ID NO: 105 - protein, 464 aa, Artificial Sequence
  Synthetic polypeptide:  18D7
MVVIFILLMLVTPSMTMRCIGISNRDFVEGVSGATWVDVVLEHGSCVTTMAKNKPTLDIELLKTEVTNPAVLRKLCIEASISNITTATRCPTQGEAILPEEQDQNYVCKHTYVDRGWGNGCGLFGKGSLITCAKFKCVTKLEGKIVQYENLKYSVIVTVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKTAHAKKQDVVVLGSQEGAMHTALTGATEIQMSSGTTTIFAGHLKCRLKMDKLQLKGMSYSMCTGKFQIVKEIAETQHGTILIKVKYEGTDAPCKIPFSSQDEKGVTQNGRLITANPIVTEKDSPVNIEAEPPFGESYIVVGAGEKALKLSWFKKGSSIGQMFESTYRGAKRMAILGETAWDFGSVGGLLTSLGKAVHQVFGSVYTTMFG

SEQ ID NO: 106 - protein, 463 aa, Artificial Sequence
  Synthetic polypeptide:  18E9
MTVFFILMMLVAPSYGMRCVGVGNRDFVEGLSGATWVDVVLEHGGCVTTMAKNKPTLDFELIKTEATQPATLRKYCIEAKLTNTTTATRCPTQGEPYLKEEQDQNYVCKHTYVDRGWGNGCGLFGKGSVVTCAKFQCLEPIEGKVVQHENLKYSVIVTVHTGDQHQVGNDTQGVTVEITPQASTVEAILPEYGTLGLECSPRTGLDFNEMILLTMKKKSWLVHKQWFLDLPLPWTSGASTSQETWNRKELLVTFKNAHAKRQDVTVLGSQEGAMHTALTGATEVDSGDGNLLFTGHLKCRLKMDKLQLKGMSYTMCTGKFQIVKEIAETQHGTILIKVEYKGEDAPCKIPFSSQDEKGVTQNGRLITANPIVIDKEKPVNIELEPPFGDSYIVVGAGDKALKINWYKKGSSIGKMFESTYRGAKRMAILGDTAWDFGSVGGVLNSLGKMVHQIFGSVYTTMFG

SEQ ID NO: 107 - protein, 465 aa, Artificial Sequence
  Synthetic polypeptide:  18E10
MTVFFILLMLVTPSMAMRCVGVGNRDFVEGLSGATWVDVVLEHGGCVTTMAKNKPTLDIELQKTEATQLATLRKYCIEAKLTNTTTESRCPTQGEAILPEEQDQNYVCKHTYVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKSWLVHKQWFLDLPLPWTAGADTSEVHWNHKERMVTFKTAHAKKQEVVVLGSQEGAMHTALTGATEVDSGDGNLLFTGHLKCRLRMDKLQLKGMSYSMCTGKFQIVKEIAETQHGTIVIRVQYEGDGSPCKIPLEIMDLEKRHVLGRLITANPIVIDKEKPVNIELEPPFGDSYIVVGAGDKALKINWYKKGSSIGQMFETTMRGAKRMAILGDTAWDFGSVGGLLTSLGKAVHQVFGSVYTTMFG

SEQ ID NO: 108 - protein, 460 aa, Artificial Sequence
  Synthetic polypeptide:  18E11
MTVFFILMMLVAPSYGMRCVGVGNRDFVEGLSGATWVDVVLEHGGCVTTMAKNKPTLDFELIKTTVKEVALLRTYCIEASISNITTATRCPTQGEPYLKEEQDQQYICRRDVVDRGWGNGCGLFGKGSLITCAKFKCVTKLEGNIVQPENLEYTIVITPHTGDQHQVGNDTQGVTVEITPQASTVEAILPEYGTLGLECSPRTGLDFNEMILLTMKKKSWLVHKQWFLDLPLPWTAGADTSEVHWNHKERMVTFKTAHAKKQDVVVLGSQEGAMHTALTGATEVDSGDGNLLFTGHLKCRLKMDKLQLKGMSYSMCTGKFQIVKEIAETQHGTILIKVEYKGEDAPCKIPFSTEDEKGKAHNGRLITANPIVIDKEKPVNIEAEPPFGESYIVVGAGDKALKLSWFKKGSSIGQMFESTYRGAKRMAILGETAWDFGSVGGVFTSIGKALHQVFGAIYGA

SEQ ID NO: 109 - protein, 465 aa, Artificial Sequence
  Synthetic polypeptide: 18H2
MTVFFILMMLVAPSYGMRCVGVGNRDFVEGVSGGAWVDLVLEHGSCVTTMAKNKPTLDIELLKTEVTNPATLRKYCIEAKITNITTDSRCPTQGEAILPEEQDQNYVCKHTYVDRGWGNGCGLFGKGSVVTCAKFQCLEPIEGKVVQHENLKYTVIITVHTGDQHQVGNDTSNHGVTVEITPQASTVEAILPEYGTLGLECSPRTGLDFNRVVLLTMKKKSWLVHKQWFLDLPLPWTAGADTSEVHWNHKERMVTFKVPHAKKQDVVVLGSQEGAMHTALAGATEIQMSSGNLLFTGHLKCRLKMDKLQLKGMSYSMCTGKFQIVKEIAETQHGTIVIRVQYEGDGAPCKIPFSTEDGQGKAHNGRLITANPVVTKKEEPVNIEAEPPFGESNIVIGIGDKALKINWYKKGSSIGKMFETTMRGAKRMAILGDTAWDFGSVGGLLTSLGKMVHQIFGSVYTTMFG

SEQ ID NO: 110 - protein, 460 aa, Artificial Sequence
  Synthetic polypeptide:  18H6
MVVIFILLMLVTPSMTMRCVGVGNRDFVEGLSGATWVDVVLEHGGCVTTMAKNKPTLDFELIKTTAKEVALLRTYCIEASISNITTATRCPTQGEAILPEEQDQNYVCKHTYVDRGWGNGCGLFGKGSLVTCAKFTCKKNMEGNIVQPENLEYTIVITPHTGDQHQVGNDTQGVTVEITPQASTVEAILPEYGTLGLECSPRTGLDFNRVVLLTMKKKSWLVHKQWFLDLPLPWTAGADTSEVHWNHKERMVTFKNAHAKRQDVTVLGSQEGAMHSALAGATEIQMSSGNLLFTGHLKCRLKMDKLQLKGVSYVMCTGSFKLEKEVAETQHGTVLVQVKYEGTDAPCKIPFSTEDGQGKAHNGRLITVNPIVIDKEKPVNIELEPPFGESYIVVGAGEKALKLSWFKKGSSIGKMFEATARGAKRMAILGETAWDFGSVGGLLTSLGKAVHQVFGAIYGA

SEQ ID NO: 111 - protein, 465 aa, Artificial Sequence
  Synthetic polypeptide:  21C1 PRM15 ETRUNC ("E-truncated" or "tE")
MALIFILLTAVAPSMTMRCIGISNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFKCVTKLEGKIVQYENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMDKLQLKGMSYSMCTGKFQLVKEIAETQHGTIVIRVQYEGDGSPCKIPLEIMDLEKRHVLGRLITVNPIVIDKEKPVNIEAEPPFGDSYIIIGVGDSALTLHWFRKGSSIGKMFESTYRGARRMAILGETAWDFGSVGGLLTSLGKAVHQVFGSVYTTMFG

SEQ ID NO: 112 - protein, 463 aa, Artificial Sequence
  Synthetic polypeptide:  23C12 PRM15 ETRUNC
MALIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFRKGSSIGQMFETTMRGAKRMAILGETAWDFGSVGGLLTSLGKAVHQVFGSVYTTMFG

SEQ ID NO: 113 - protein, 448 aa, Artificial Sequence
  Synthetic polypeptide:  23D5 PRM15 ETRUNC
MGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHNGDTHAVGNDTQGVTVEITPQAPTSEIQLTDYGALTLDCSPRTGLDFNRVVLLTMKKKSWLVHKQWFLDLPLPWTSGASTSQETWNRQDLLVTFKTAHAKKQEVVVLGSQEGAMHTALTGTTEIQTSGTTTIFAGHLKCRLKMDKLTLKGMSYVMCTGSFKLEKEVAETQHGTVLVQVKYEGTGAPCKVPIEIRDVNKEKVVGRIISSTPLAENTNSVTNIELEPPFGDSYIVIGVGDSALTLHWFRKGSSIGKMFESTARGARRMAILGDTAWDFGSIGGVFTSVGK

SEQ ID NO: 114 - protein, 448 aa, Artificial Sequence
  Synthetic polypeptide:  23F5 PRM15 ETRUNC
MTVFFVLMMLVAPSMAMRCVGIGNRDFVEGLSGGAWVDLVLEHGGCVTTMAKNKPTLDFELIKTEATQPATLRKYCIEAKLTNTTTESRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKTWLVHKQWFLDLPLPWTAGADTREVHWNHKERMVTFKVPHAKRQDVTVLGSQEGAMHSALAGATEVDSGDGNHMFAGHLKCRLKMDKLELKGMSYSMCTGKFRIVKEIAETQHGTIVIRVQYEGDGSPCKIPLEIMDLEKRHVLGRLITVNPIVIDKEKPVNIEAEPPFGESYIVVGAGEKALKLSWFKKGSSIGKMFEATARGARRMAILGDTAWDFGSIGGVFTSVGK

SEQ ID NO: 115 - protein, 460 aa, Artificial Sequence
  Synthetic polypeptide:  23G3 PRM15 ETRUNC
MGIIFILLMLVTPSMAMRCVGIGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVIDKEKPVNIEAEPPFGESNIVIGIGDKALKINWFKKGSSIGKMFEATARGARRMAILGDTAWDFGSIGGVFTSIGKALHQVFGAIYGA

SEQ ID NO: 116 - protein, 448 aa, Artificial Sequence
  Synthetic polypeptide:  23H7 PRM15 ETRUNC
MGIIFILLMLVTPSMTMRCVGIGNRDFVEGLSGATWVDVVLEHGSCVTTMAKNKPTLDIELLKTEVTNPAVLRKLCIEAKISNTTTDSRCPTQGEATLVEEQDTNFVCRRTFVDRGWGNGCGLFGKGSLITCAKFKCLEPIEGKVVQHENLKYTVIITVHTGDQHQVGNDTQGVTVEITPQASTVEAILPEYGTLGLECSPRTGLDFNRVVLLTMKKKSWLVHKQWFLDLPLPWTSGASTSQETWNRQDLLVTFKTAHAKKQEVVVLGSQEGAMHTALTGATEIQTSGTTTIFTGHLKCRLKMDKLTLKGVSYVTCTGSFKLEKEVAETQHGTVLVQVKYEGTDAPCKIPFSSQDEKGVTQNGRLITANPVVTKKEEPVNIEAEPPFGESNIVIGIGDKALKINWYKKGSSIGKMFEATARGARRMAILGDTAWDFGSIGGVFTSVGK

SEQ ID NO: 117 - protein, 167 aa, Dengue virus type 1
  DEN-1 REST OF C15/PRM
MRSVTMILMLLPTALAFHLTTRGGEPTLIVSKQERGKSLLFKTSAGVNMCTLIAMDLGELCEDTMTYKCPRMTEAEPDDVDCWCNATDTWVTYGTCSQTGEHRRDKRSVALDPHVGLGLETRTETWMSSEGAWKQIQKVETWALRHPGFTVIALFLAHAIGTSITQK

SEQ ID NO: 118 - protein, 171 aa, Dengue virus type 2
  DEN-2 REST OF C15/PRM
MNRRRRTVGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFIIMAAILAYTIGTTHFQR

SEQ ID NO: 119 - protein, 167 aa, Dengue virus type 3
  DEN-3 REST OF C15/PRM
MKTSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQK

SEQ ID NO: 120 - protein, 167 aa, Dengue virus type 4
  DEN-4 REST OF C15/PRM
MRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPRFALLAGFMAYMIGQTGIQR

SEQ ID NO: 121 - protein, 171 aa, Artificial Sequence
  Synthetic polypeptide:  21C1 REST OF C15/PRM
MNRRRRTVGVIIMLIPTAMAFHLTTRNGEPHMIVGRQEKGKSLLFKTEDGVNMCTLMAIDLGELCEDTVTYKCPLLVNTEPEDIDCWCNLTSAWVTYGTCNQAGEHRRDKRSVALAPHVGMGLETRTETWMSSEGAWKHAQRIETWILRHPGFIIMAAILAYTIGTTHFQR

SEQ ID NO: 122 - protein, 167 aa, Artificial Sequence
  Synthetic polypeptide:  23C12 REST OF C15/PRM
MRSVTMILMLLPTALAFHLTTRGGEPTLIVSKQERGKSLLFKTASGINMCTLIAMDLGEMCDDTVTYKCPHITEVEPEDIDCWCNLTSTWVTYGTCNQAGEHRRDKRSVALVPHVGMGLETRTETWMSSEGAWKHAQRIETWILRHPGFIIMAAILAYTIGTTHFQR

SEQ ID NO: 123 - protein, 167 aa, Artificial Sequence
  Synthetic polypeptide:  23D5 REST OF C15/PRM
MKTSLCLMMMLPATLAFHLTSRDGEPRMIVGKNERGKSLLFKTEDGVNMCTLIAMDLGELCEDTMTYKCPRMTEVEPEDIDCWCNLTSTWVTYGTCNQAGEHRRDKRSVALAPHVGMGLDTRTQTWMSAEGAWRQVEKVETWALRHPGFTILALFLAHYIGTSITQK

SEQ ID NO: 124 - protein, 167 aa, Artificial Sequence
  Synthetic polypeptide:  23F5 REST OF C15/PRM
MRSAITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLDTRTQTWMSAEGAWKHAQRVESWILRNPRFALLAGFMAYMIGQTGIQR

SEQ ID NO: 125 - protein, 167 aa, Artificial Sequence
  Synthetic polypeptide:  23G3 REST OF C15/PRM
MKTSLCLMMMLPATLAFHLTTRNGEPHMIVGRQEKGKSLLFKTSAGVNMCTLIAMDLGELCEDTMTYKCPRMTEAEPEDIDCWCNLTSTWVTYGTCTQSGERRREKRSVALTPHSGMGLETRAETWMSSEGAWKQIQKVETWALRHPGFTVIALFLAHAIGTSITQK

SEQ ID NO: 126 - protein, 167 aa, Artificial Sequence
  Synthetic polypeptide:  23H7 REST OF C15/PRM
MKTSLCLMMMLPATLAFHLTSRDGEPLMIVAKHERGRPLLFKTTEGINKCTLIAMDLGEMCEDTVTYKCPLLRQNEPDDVDCWCNATDTWVTYGTCSQTGEHRRDKRSVALDPHVGLGLETRTETWMSSEGAWKQIQKVETWALRHPGFTVIALFLAHAIGTSITQK

SEQ ID NO: 127 - protein, 61 aa, Dengue virus type 1
  DEN-1 REST OF ENV
LIHQIFGTAYGVLFSGVSWTMKIGIGILLTWLGLNSRSTSLSMTCIAVGMVTLYLGVMVQA

SEQ ID NO: 128 - protein, 49 aa, Dengue virus type 2
  DEN-2 REST OF ENV
AFSGVSWTMKILIGVIITWIGMNSRSTSLSVSLVLVGVITLYLGAMVQA

SEQ ID NO: 129 - protein, 50 aa, Dengue virus type 3
  DEN-3 REST OF ENV
ALFSGVSWIMKIGIGVLLTWIGLNSKNTSMSFSCIAIGIITLYLGVVVQA

SEQ ID NO: 130 - protein, 46 aa, Dengue virus type 4
  DEN-4 REST OF ENV
GVSWMVRILIGFLVLWIGTNSRNTSMAMSCIAVGGITLFLGFTVHA

SEQ ID NO: 131 - protein, 46 aa, Artificial Sequence
  Synthetic polypeptide:  21C1 REST OF ENV
GVSWMVRILIGFLVLWIGTNSRNTSMAMSCIAVGGITLFLGAMVQA

SEQ ID NO: 132 - protein, 46 aa, Artificial Sequence; identical to SEQ ID NO: 130
  Synthetic polypeptide:  23C12 REST OF ENV

SEQ ID NO: 133 - protein, 61 aa, Artificial Sequence
  Synthetic polypeptide:  23D5 rest of ENV
LIHQIFGTAYGVLFSGVSWTMKIGIGILLTWLGLNSRSTSLSMTCIAVGMVTLYLGVVVQA

SEQ ID NO: 134 - protein, 61 aa, Artificial Sequence; identical to SEQ ID NO: 127
  Synthetic polypeptide:  23F5 rest of ENV

SEQ ID NO: 135 - protein, 49 aa, Artificial Sequence; identical to SEQ ID NO: 128
  Synthetic polypeptide:  23G3 rest of Env

SEQ ID NO: 136 - protein, 61 aa, Artificial Sequence
  Synthetic polypeptide:  23H7 REST OF ENV
LIHQIFGTAYGVLFSGVSWTMKIGIGILLTWLGLNSRSTSLSMTCIAVGMVTLYLGAMVQA

SEQ ID NO: 137 - protein, 46 aa, Artificial Sequence
  Synthetic polypeptide:  SEQ PATTERN REST OF ENV
  VARIANT 5: Xaa =  M, I, or T
  VARIANT 6: Xaa =  V or M
  VARIANT 7: Xaa =  K or R
  VARIANT 9: Xaa =  L or G
  VARIANT 12: Xaa =  V, I, or F
  VARIANT 13: Xaa =  I or L
  VARIANT 14: Xaa =  I, L, or V
  VARIANT 15: Xaa =  T or L
  VARIANT 17: Xaa =  I or L
  VARIANT 19: Xaa =  M, L, or T
  VARIANT 22: Xaa =  K or R
  VARIANT 23: Xaa =  S or N
  VARIANT 26: Xaa =  L or M
  VARIANT 27: Xaa =  S or A
  VARIANT 28: Xaa =  V, M, or F
  VARIANT 29: Xaa =  S or T
  VARIANT 30: Xaa =  L or C
  VARIANT 31: Xaa =  V or I
  VARIANT 32: Xaa =  L or A
  VARIANT 33: Xaa =  V or I
  VARIANT 35: Xaa =  V, M, I, or G
  VARIANT 36: Xaa =  V or I
  VARIANT 39: Xaa =  Y or F
  VARIANT 42: Xaa =  A, V, or F
  VARIANT 43: Xaa =  M, V, or T
  VARIANT 45: Xaa =  Q or H
GVSWXXXIXIGXXXXWXGXNSXXTSXXXXXXXXGXXTLXLGXXVXA

SEQ ID NO: 138 - protein, 167 aa, Artificial Sequence
  Synthetic polypeptide:  SEQ PATTERN REST OF C15/PRM
  VARIANT 1: Xaa =  M or R
  VARIANT 2: Xaa =  R or K
  VARIANT 3: Xaa =  S or T
  VARIANT 4: Xaa =  V, S, T, or A
  VARIANT 5: Xaa =  T, L, G, or I
  VARIANT 6: Xaa =  M, C, V, or T
  VARIANT 7: Xaa =  I or L
  VARIANT 8: Xaa =  L, M, or I
  VARIANT 9: Xaa =  M or C
  VARIANT 10: Xaa =  L or M
  VARIANT 11: Xaa =  L or I
  VARIANT 13: Xaa =  T or A
  VARIANT 14: Xaa =  A, T, or V
  VARIANT 15: Xaa =  L or M
  VARIANT 18: Xaa =  H or S
  VARIANT 20: Xaa =  T or S
  VARIANT 21: Xaa =  T or S
  VARIANT 23: Xaa =  G, D, or N
  VARIANT 27: Xaa =  T, L, R, or H
  VARIANT 28: Xaa =  L or M
  VARIANT 31: Xaa =  S, A, or G
  VARIANT 32: Xaa =  K or R
  VARIANT 33: Xaa =  Q, H, or N
  VARIANT 35: Xaa =  R or K
  VARIANT 37: Xaa =  K or R
  VARIANT 38: Xaa =  S or P
  VARIANT 44: Xaa =  S, T, A, or E
  VARIANT 45: Xaa =  A, E, S, or D
  VARIANT 47: Xaa =  V or I
  VARIANT 49: Xaa =  M or K
  VARIANT 53: Xaa =  I or M
  VARIANT 55: Xaa =  M or I
  VARIANT 60: Xaa =  L or M
  VARIANT 62: Xaa =  E or D
  VARIANT 65: Xaa =  M, V, or I
  VARIANT 71: Xaa =  R, L, or H
  VARIANT 72: Xaa =  M, L, or I
  VARIANT 73: Xaa =  T, R, or V
  VARIANT 74: Xaa =  E, Q, or N
  VARIANT 75: Xaa =  A, N, V, or T
  VARIANT 78: Xaa =  D or E
  VARIANT 80: Xaa =  V or I
  VARIANT 86: Xaa =  A, L, or S
  VARIANT 88: Xaa =  D or S
  VARIANT 89: Xaa =  T or A
  VARIANT 92: Xaa =  T or M
  VARIANT 97: Xaa =  S, N, or T
  VARIANT 98: Xaa =  Q or T
  VARIANT 99: Xaa =  T, A, or S
  VARIANT 102: Xaa =  H or R
  VARIANT 105: Xaa =  D or E
  VARIANT 112: Xaa =  D, A, T, or V
  VARIANT 115: Xaa =  V or S
  VARIANT 117: Xaa =  L or M
  VARIANT 120: Xaa =  E or D
  VARIANT 123: Xaa =  T or A
  VARIANT 124: Xaa =  E or Q
  VARIANT 129: Xaa =  S or A
  VARIANT 134: Xaa =  K or R
  VARIANT 135: Xaa =  H or Q
  VARIANT 136: Xaa =  I, V, or A
  VARIANT 137: Xaa =  Q or E
  VARIANT 138: Xaa =  K or R
  VARIANT 139: Xaa =  V or I
  VARIANT 141: Xaa =  T or S
  VARIANT 143: Xaa =  A or I
  VARIANT 146: Xaa =  H or N
  VARIANT 148: Xaa =  G or R
  VARIANT 150: Xaa =  T, I, or A
  VARIANT 151: Xaa =  V, I, or L
  VARIANT 152: Xaa =  I, L, or M
  VARIANT 154: Xaa =  L, A, or G
  VARIANT 155: Xaa =  F or I
  VARIANT 156: Xaa =  L or M
  VARIANT 158: Xaa =  H or Y
  VARIANT 159: Xaa =  A, Y, T, or M
  VARIANT 162: Xaa =  T or Q
  VARIANT 163: Xaa =  T or S
  VARIANT 164: Xaa =  I, L, H, or G
  VARIANT 165: Xaa =  T, F, or I
  VARIANT 167: Xaa =  K or R
XXXXXXXXXXXPXXXAFXLXXRXGEPXXIVXXXEXGXXLLFKTXXGXNXCTLXAXDLGEXCXDTXTYKCPXXXXXEPXDXDCWCNXTXXWVXYGTCXXXGEXRRXKRSVALXPHXGXGLXTRXXTWMSXEGAWXXXXXXEXWXLRXPXFXXXAXXXAXXIGXXXXQX

SEQ ID NO: 139 - protein, 675 aa, Artificial Sequence
  Synthetic polypeptide:  2G11-D4
MRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPRFALLAGFMAYMIGQTGIQRTVFFVLMMLVAPSYGMRCVGVGNRDFVEGVSGATWVDVVLEHGGCVTTMAKNKPTLDFELIKTTAKEVALLRTYCIEASISNITTATRCPTQGEPYLKEEQDQQYICRRDVVDRGWGNGCGLFGKGSLITCAKFKCVTKLEGNIVQPENLEYTIVITPHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHSALAGATEIQMSSGNLLFTGHLKCRLKMDKLQLKGMSYTMCTGKFQIVKEIAETQHGTILIKVEYKGEDAPCKIPFSTEDEKGVTQNGRLITANPIVTEKDSPVNIEAEPPFGESYIVVGAGEKALKLSWFKKGSSIGQMFESTYRGAKRMAILGETAWDFGSVGGLLTSLGKAVHQVFGSVYTTMFGGVSWMVRILIGFLVLWIGTNSRNTSMAMSCIAVGGITLFLGFTVHA

SEQ ID NO: 140 - protein, 677 aa, Artificial Sequence
  Synthetic polypeptide: 5/21-D1
MRSVTMILMLLPTALAFHLTTRGGEPTLIVSKQERGKSLLFKTSAGVNMCTLIAMDLGELCEDTMTYKCPRMTEAEPDDVDCWCNATDTWVTYGTCSQTGEHRRDKRSVALDPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPATLRKYCIEAKITNITTDSRCPTQGEAILPEEQDQNYVCKHTYVDRGWGNGCGLFGKGSLVTCAKFTCKKNMEGNIVQPENLEYTIVITPHSGEEHAVGNDTGKHGKEIKITPQSSITEAELTGYGTVTMECSPRTGLDFNRVVLLTMKKKSWLVHKQWFLDLPLPWTAGADTSEVHWNHKERMVTFKVPHAKRQDVTVLGSQEGAMHSALAGATEIQMSSGNLLFTGHLKCRLRMDKLQLKGMSYVMCTGKFQIVKEIAETQHGTIVIRVQYEGDGSPCKIPLEIMDLEKRHVLGRLITVNPIVIDKEKPVNIEAEPPFGESYIVVGVGDSALTLHWFRKGSSIGQMFETTMRGAKRMAILGDTAWDFGSIGGVFTSVGKLIHQIFGTAYGVLFSGVSWTMKIGIGILLTWLGLNSRSTSLSMTCIAVGMVTLYLGVMVQA

SEQ ID NO: 141 - protein, 676 aa, Artificial Sequence
  Synthetic polypeptide: 6E12-D4
MRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPRFALLAGFMAYMIGQTGIQRTVFFVLMMLVAPSYGMRCVGVGNRDFVEGVSGATWVDVVLEHGSCVTTMAKNKPTLDIELLKTEVTNPAVLRKLCIEASISNITTATRCPTQGEAILPEEQDQNYVCKHTYVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKTAHAKKQDVVVLGSQEGAMHTALTGATEIQMSSGTTTIFAGHLKCKVRMDKLTLKGVSYVMCTGSFKLEKEVAETQHGTVLVQVKYEGTDAPCKIPFSSQDEKGVTQNGRLITANPIVIDKEKPVNIEAEPPFGDSYIIIGVEPGQLKLHWFKKGSSIGQMFETTMRGAKRMAILGDTAWDFGSVGGLLTSLGKMVHQIFGSVYTTMFGGVSWMVRILIGFLVLWIGTNSRNTSMAMSCIAVGGITLFLGFTVHA

SEQ ID NO: 142 - protein, 681 aa, Artificial Sequence
  Synthetic polypeptide: 21C1 (C15/full prM/full E)
MNRRRRTVGVIIMLIPTAMAFHLTTRNGEPHMIVGRQEKGKSLLFKTEDGVNMCTLMAIDLGELCEDTVTYKCPLLVNTEPEDIDCWCNLTSAWVTYGTCNQAGEHRRDKRSVALAPHVGMGLETRTETWMSSEGAWKHAQRIETWILRHPGFIIMAAILAYTIGTTHFQRALIFILLTAVAPSMTMRCIGISNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFKCVTKLEGKIVQYENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMDKLQLKGMSYSMCTGKFQLVKEIAETQHGTIVIRVQYEGDGSPCKIPLEIMDLEKRHVLGRLITVNPIVIDKEKPVNIEAEPPFGDSYIIIGVGDSALTLHWFRKGSSIGKMFESTYRGARRMAILGETAWDFGSVGGLLTSLGKAVHQVFGSVYTTMFGGVSWMVRILIGFLVLWIGTNSRNTSMAMSCIAVGGITLFLGAMVQA

SEQ ID NO: 143 - protein, 675 aa, Artificial Sequence
  Synthetic polypeptide:  23C12(C15/full prM/full E)
MRSVTMILMLLPTALAFHLTTRGGEPTLIVSKQERGKSLLFKTASGINMCTLIAMDLGEMCDDTVTYKCPHITEVEPEDIDCWCNLTSTWVTYGTCNQAGEHRRDKRSVALVPHVGMGLETRTETWMSSEGAWKHAQRIETWILRHPGFIIMAAILAYTIGTTHFQRALIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFRKGSSIGQMFETTMRGAKRMAILGETAWDFGSVGGLLTSLGKAVHQVFGSVYTTMFGGVSWMVRILIGFLVLWIGTNSRNTSMAMSCIAVGGITLFLGFTVHA

SEQ ID NO: 144 - protein, 675 aa, Artificial Sequence
  Synthetic polypeptide:  23D5(C15/full prM/full E)
MKTSLCLMMMLPATLAFHLTSRDGEPRMIVGKNERGKSLLFKTEDGVNMCTLIAMDLGELCEDTMTYKCPRMTEVEPEDIDCWCNLTSTWVTYGTCNQAGEHRRDKRSVALAPHVGMGLDTRTQTWMSAEGAWRQVEKVETWALRHPGFTILALFLAHYIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHNGDTHAVGNDTQGVTVEITPQAPTSEIQLTDYGALTLDCSPRTGLDFNRVVLLTMKKKSWLVHKQWFLDLPLPWTSGASTSQETWNRQDLLVTFKTAHAKKQEVVVLGSQEGAMHTALTGTTEIQTSGTTTIFAGHLKCRLKMDKLTLKGMSYVMCTGSFKLEKEVAETQHGTVLVQVKYEGTGAPCKVPIEIRDVNKEKVVGRIISSTPLAENTNSVTNIELEPPFGDSYIVIGVGDSALTLHWFRKGSSIGKMFESTARGARRMAILGDTAWDFGSIGGVFTSVGKLIHQIFGTAYGVLFSGVSWTMKIGIGILLTWLGLNSRSTSLSMTCIAVGMVTLYLGVVVQA

SEQ ID NO: 145 - protein, 675 aa, Artificial Sequence
  Synthetic polypeptide: 23F5(C15/full prM/full E)
MRSAITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLDTRTQTWMSAEGAWKHAQRVESWILRNPRFALLAGFMAYMIGQTGIQRTVFFVLMMLVAPSMAMRCVGIGNRDFVEGLSGGAWVDLVLEHGGCVTTMAKNKPTLDFELIKTEATQPATLRKYCIEAKLTNTTTESRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKTWLVHKQWFLDLPLPWTAGADTREVHWNHKERMVTFKVPHAKRQDVTVLGSQEGAMHSALAGATEVDSGDGNHMFAGHLKCRLKMDKLELKGMSYSMCTGKFRIVKEIAETQHGTIVIRVQYEGDGSPCKIPLEIMDLEKRHVLGRLITVNPIVIDKEKPVNIEAEPPFGESYIVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQA

SEQ ID NO: 146 - protein, 675 aa, Artificial Sequence
  Synthetic polypeptide:  23G3(C15/full prM/full E)
MKTSLCLMMMLPATLAFHLTTRNGEPHMIVGRQEKGKSLLFKTSAGVNMCTLIAMDLGELCEDTMTYKCPRMTEAEPEDIDCWCNLTSTWVTYGTCTQSGERRREKRSVALTPHSGMGLETRAETWMSSEGAWKQIQKVETWALRHPGFTVIALFLAHAIGTSITQKGIIFILLMLVTPSMAMRCVGIGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVIDKEKPVNIEAEPPFGESNIVIGIGDKALKINWFKKGSSIGKMFEATARGARRMAILGDTAWDFGSIGGVFTSIGKALHQVFGAIYGAAFSGVSWTMKILIGVIITWIGMNSRSTSLSVSLVLVGVITLYLGAMVQA

SEQ ID NO: 147 - protein, 677 aa, Artificial Sequence
  Synthetic polypeptide:  2/7-D1 extended with D1 to C15/full prM/full E with DEN-1 amino acid residues
MRSVTMILMLLPTALAFHLTTRGGEPTLIVSKQERGKSLLFKTSAGVNMCTLIAMDLGELCEDTMTYKCPRMTEAEPDDVDCWCNATDTWVTYGTCSQTGEHRRDKRSVALDPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELIKTEATQPATLRKYCIEAKLTNTTTESRCPTQGEPYLKEEQDQNYVCKHTYVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKTWLVHKQWFLDLPLPWTAGASTSQETWNRKELLVTFKNAHAKKQEVVVLGSQEGAMHTALTGATEVDSGDGNLLFTGHLKCRLKMDKLQLKGMSYSMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFESTYRGAKRMAILGDTAWDFGSIGGVFTSVGKLIHQIFGTAYGVLFSGVSWTMKIGIGILLTWLGLNSRSTSLSMTCIAVGMVTLYLGVMVQA

SEQ ID NO: 148 - protein, 675 aa, Artificial Sequence
  Synthetic polypeptide:  23H7 (C15/full prM/full E)
MKTSLCLMMMLPATLAFHLTSRDGEPLMIVAKHERGRPLLFKTTEGINKCTLIAMDLGEMCEDTVTYKCPLLRQNEPDDVDCWCNATDTWVTYGTCSQTGEHRRDKRSVALDPHVGLGLETRTETWMSSEGAWKQIQKVETWALRHPGFTVIALFLAHAIGTSITQKGIIFILLMLVTPSMTMRCVGIGNRDFVEGLSGATWVDVVLEHGSCVTTMAKNKPTLDIELLKTEVTNPAVLRKLCIEAKISNTTTDSRCPTQGEATLVEEQDTNFVCRRTFVDRGWGNGCGLFGKGSLITCAKFKCLEPIEGKVVQHENLKYTVIITVHTGDQHQVGNDTQGVTVEITPQASTVEAILPEYGTLGLECSPRTGLDFNRVVLLTMKKKSWLVHKQWFLDLPLPWTSGASTSQETWNRQDLLVTFKTAHAKKQEVVVLGSQEGAMHTALTGATEIQTSGTTTIFTGHLKCRLKMDKLTLKGVSYVTCTGSFKLEKEVAETQHGTVLVQVKYEGTDAPCKIPFSSQDEKGVTQNGRLITANPVVTKKEEPVNIEAEPPFGESNIVIGIGDKALKINWYKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGAMVQA

SEQ ID NO: 149 - protein, 450 aa, Dengue virus type 1
  DEN-1 PRM15/trunc E (truncated envelope) parent
MGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVIDKEKPVNIEAEPPFGESYIVVGAGEKALKLSWFKKGSSIGKMFEATARGARRMAILGDTAWDLGSIGGVFTSVGK

SEQ ID NO: 150 - protein, 462 aa, Dengue virus type 2
  DEN-2 PRM15/trunc E parent
MGLILILQTAVAPSMTMRCIGISNRDFVEGVSGGSWVDIVLEHGSCVTTMAKNKPTLDFELIKTEATQPATLRKYCIEAKLTNTTTESRCPTQGEPSLNEEQDKRFVCKHSMVDRGWGNGCGLFGKGGIVTCAMFTCKKNMEGNIVQPENLEYTIVITPHSGEEHAVGNDTGKHGKEIKITPQSSITEAELTGYGTVTMECSPRTGLDFNEIVLLQMEDKAWLVHRQWFLDLPLPWLPGADTQGSNRIQKETLVTFKNPHAKKQDVVVLGSQEGAMHTALTGATEIQMSSGNLLFTGHLKCRLRMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFKKGSSIGQMFETTMRGAKRMAILGDTAWDFGSLGGVFTSIGKALHQVFGAIYGA

SEQ ID NO: 151 - protein, 459 aa, Dengue virus type 3
  DEN-3 PRM15/trunc E parent
MVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYT

SEQ ID NO: 152 - protein, 465 aa, Dengue virus type 4
  DEN-4 PRM15/trunc E parent
MTVFFILMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPLAENTNSVTNIELEPPFGDSYIVIGVGDSALTLHWFRKGSSIGKMFESTYRGAKRMAILGETAWDFGSVGGLLTSLGKAVHQVFGSVYTTMFG

SEQ ID NO: 153 - protein, 432 aa, Artificial Sequence
  Synthetic polypeptide: 23D5 ETRUNC ("trunc E" or "truncated E") only (no prM)
MRCVGIGNRDFVEGLSGATWVDVVLEHGSCVTTMAKNKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHNGDTHAVGNDTQGVTVEITPQAPTSEIQLTDYGALTLDCSPRTGLDFNRVVLLTMKKKSWLVHKQWFLDLPLPWTSGASTSQETWNRQDLLVTFKTAHAKKQEVVVLGSQEGAMHTALTGTTEIQTSGTTTIFAGHLKCRLKMDKLTLKGMSYVMCTGSFKLEKEVAETQHGTVLVQVKYEGTGAPCKVPIEIRDVNKEKVVGRIISSTPLAENTNSVTNIELEPPFGDSYIVIGVGDSALTLHWFRKGSSIGKMFESTARGARRMAILGDTAWDFGSIGGVFTSVGK

SEQ ID NO: 154 - protein, 444 aa, Artificial Sequence
  Synthetic polypeptide:  23G3 ETRUNC ("trunc E") only (no prM)
MRCVGIGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVIDKEKPVNIEAEPPFGESNIVIGIGDKALKINWFKKGSSIGKMFEATARGARRMAILGDTAWDFGSIGGVFTSIGKALHQVFGAIYGA

SEQ ID NO: 155 - protein, 432 aa, Artificial Sequence
  Synthetic polypeptide:  23H7 ETRUNC only (no prM)
MRCVGIGNRDFVEGLSGATWVDVVLEHGSCVTTMAKNKPTLDIELLKTEVTNPAVLRKLCIEAKISNTTTDSRCPTQGEATLVEEQDTNFVCRRTFVDRGWGNGCGLFGKGSLITCAKFKCLEPIEGKVVQHENLKYTVIITVHTGDQHQVGNDTQGVTVEITPQASTVEAILPEYGTLGLECSPRTGLDFNRVVLLTMKKKSWLVHKQWFLDLPLPWTSGASTSQETWNRQDLLVTFKTAHAKKQEVVVLGSQEGAMHTALTGATEIQTSGTTTIFTGHLKCRLKMDKLTLKGVSYVTCTGSFKLEKEVAETQHGTVLVQVKYEGTDAPCKIPFSSQDEKGVTQNGRLITANPVVTKKEEPVNIEAEPPFGESNIVIGIGDKALKINWYKKGSSIGKMFEATARGARRMAILGDTAWDFGSIGGVFTSVGK

SEQ ID NO: 156 - DNA, 1386 bp, Artificial Sequence
  Synthetic polynucleotide: 2/7 Round I shuffled clone
atggtggtgatcttcatcctgctgatgctggtgaccccctccatgacaatgaggtgcatcggcatcagcaacagggacttcgtggagggcgtgagcggcgccacctgggtggacgtggtgctggagcacggcagctgcgtgaccaccatggccaagaacaagcccaccctggacatcgagctgatcaagaccgaggccacccagcccgccaccctgaggaagtactgcatcgaggccaagctgaccaataccaccaccgagagcaggtgccccacccagggcgagccctacctgaaggaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 157 - DNA, 1389 bp, Artificial Sequence
  Synthetic polynucleotide: 2G11 Round I shuffled clone
atgaccgtgttcttcatcctgctgatgctggtgaccccctctatggccatgaggtgcgtgggcatcggcaaccgcgacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacagcgccctggccggcgccaccgagatccagatgagcagcggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcgccggcgagaaggccctgaagctgagctggttcaagaagggcagcagcatcggccagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 158 - DNA, 1386 bp, Artificial Sequence
  Synthetic polynucleotide: 5/21 Round I shuffled clone
atgaccgtgttcttcatcctgatgatgctggtggccccctcctacggcatgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgatcgacaaggagaagcccgtgaacatcgaggccgagccccccttcggcgagagctacatcgtggtcggcgtgggcgacagcgccctgaccctgcactggttcaggaagggcagcagcatcggccagatgttcgagaccaccatgaggggcgccaagaggatggccatcttgggcgacaccgcctgggacttcggcagcctgggcggcgtgttcaccagcatcggcaaggccctgcaccaggtgttcggcgccatctacggcgcc

SEQ ID NO: 159 - DNA, 1392 bp, Artificial Sequence
  Synthetic polynucleotide: 6E12 Round I shuffled clone
atgaccgtgttcttcatcctgatgatgctggtggccccctcctacggcatgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaccaccaccatcttcgccggccacctgaagtgcaaggtgaggatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccatcgtgatcgacaaggagaagcccgtgaacatcgaggccgagcccccctttggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacttcggcagcgtgggcggcctgctgaccagcctgggcaagatggtgcaccagatcttcggcagcgtgtacaccaccatgttcggc

SEQ ID NO: 160 - DNA, 1329 bp, Artificial Sequence
  Synthetic polynucleotide: 6C6 Round I shuffled clone
atgaccgtgttcttcatcctgatgatgctggtgaccccctctatggccatgaggtgcgtgggcatcggcaaccgcgacttcgtggagggcgtgagcggcggcgcctgggtggacctggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcggcatcgtgacctgcgccatgttcacctgcaagaagaacatggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatgatcctgatgaagatgaagaacaaggcctggatggtgcacaggcagtggttcctggacctgcccctgccctggaccgccggcgccgacaccgagacccccacctggaacaggaaggagctgctggtgaccttcaagaacgcccacgccaagaagcaggaggtggtggtgctgggcagccaggagggcgccatgcacagcgccctggccggcgccaccgaggtggacagcggcgacggcaaccacatgttcgccggccacctgaagtgcaaggtgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcactgtgaaccccatcgtgaccgagaaggacagccccgtgaacatcgaggccgagccccccttcggcgacagctacatcatcatcggcgtggagcccggccagctgaagctgcactggttcaagaagggcagcagcatcggcaagatgttcgaggccaccgccaggggcgccaggaggatggccatcctgggcgacaccgcctgggacttcggcagcgcctacacc

SEQ ID NO: 161 - DNA, 1380 bp, Artificial Sequence
  Synthetic polynucleotide: 6F4 Round I shuffled clone
atggccgtgttcttcatcctgctgatgctggtgaccccctccatgacaatgaggtgcgtgggcatcggcaaccgcgacttcgtggagggcgtgagcggcggcgcctgggtggacctggtgctggagcacggcggctgcgtgaccaccatggccaagaacaagcccaccctggacttcgagctgatcaagaccgaggccacccagcccgccaccctgaggaagtactgcatcgaggccaagctgaccaataccaccaccgagagcaggtgccccacccagggcgaggccatcctgcccgaggagcaggaccagcagtacatctgcaggagggacgtggtggacaggggctggggcaacggctgcggcctgttcggcaagggcagcctgatcacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagagctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaaggtgaggatggagaagctgcgcatcaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtggagcccggccagctgaagctgcactggttcaagaagggcagcagcatcggccagatgttcgaggccaccgccaggggcgccaggaggatggccatcctgggcgacaccgcctgggacttcggcagcgtgggcggcgtgttcaccagcatcggcaaggccctgcaccaggtgttcggcgccatctacggcgcc

SEQ ID NO: 162 - DNA, 1392 bp, Artificial Sequence
  Synthetic polynucleotide: 7A9 Round I shuffled clone
atgaccgtgttcttcatcctgatgatgctggtggccccctcctacgccatgaggtgcgtgggcatcggcaaccgcgacttcgtggagggcgtgagcggcgccacctgggtggacgtggtgctggagcacggcggctgcgtgaccaccatggccaagaacaagcccaccctggacatcgagctgcagaagaccgaggccacccagctggccaccctgaggaagctgtgcatcgaggccagcatcagcaacatcaccaccgccaccaggtgccccacccagggcgaggccaccctggtggaggagcaggacaccaacttcgtgtgcaggaggaccttcgtggacaggggctggggcaacggctgcggcctgttcggcaagggcagcctggtgacctgcgccaagttccagtgcctggagcccatcgagggcaaggtggtgcagcacgagaacctgaagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatgatcctgctgaccatgaagagcaagacctggctggtgcacaagcagtggttcctggacctgcccctgccctggaccgccggcgccgacaccagcgaggtgcactggaaccacaaggagaggatggtgaccttcaagaacgcccacgccaagaagcaggaggtggtggtgctgggcagccaggagggcgccatgcacaccgccctgaccggcaccaccgagatccagaacagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtggagcccggccagctgaagctgcactggttcaggaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 163 - DNA, 1386 bp, Artificial Sequence
  Synthetic polynucleotide: 11E2 Round II shuffled clone
atgaccgtgttcttcatcctgctgatgctggtggccccctcctacggcatgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctactgaccatgaagaagaagacctggctggtgcacaagcagtggttcctggacctgcccctgccctggaccgccggcgccagcaccagccaggagacctggaacaggaaggagctgctggtgaccttcaagaacgcccacgccaagaggcaggacgtgaccgtgctgggcagccaggagggcgccatgcacagcgccctgaccggcgccaccgagatccagatgagcagcggcaacctgctgttcgccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccctggagatcatggacctggagaagaggcacgtgctgggcaggctgatcaccgtgaaccccatcgtgaccgagaaggacagccccgtgaacatcgaggccgagccccccttcggcgagagctacatcgtggtcggcgtgggcgacagcgccctgaccctgcactggttcaggaagggcagcagcatcggccagatgttcgaggccaccgccaggggcgccaagaggatggccatcctgggcgacaccgcctgggacttcggcagcgtgggcggcgtgttcaccagcatcggcaaggccctgcaccaggtgttcggcgccatctacggcgcc

SEQ ID NO: 164 - DNA, 1395 bp, Artificial Sequence
  Synthetic polynucleotide: 12E3 Round II shuffled clone
atggccgtgttcttcatcctgatgatgctggtggccccctcctacggcatgaggtgcgtgggcgtgggcaacagggacttcgtggagggcctgagcggcgccacctgggtggacgtggtgctggagcacggcagctgcgtgaccaccatggccaagaacaagcccaccctggacatcgagctgatcaagaccaccgccaaggaggtggccctgctgaggacctactgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacagggtggtgctgctgaccatgaagaagaagagctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgagagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 165 - DNA, 1395 bp, Artificial Sequence
  Synthetic polynucleotide: 13E2 Round II shuffled clone
atgaccgtgttcttcatcctgatgatgctggtgaccccctctatggccatgaggtgcgtgggcatcggcaaccgcgacttcgtggagggcgtgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatgatcctgctgaccatgaagaagaagagctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacaccatgtgcaccggcaagttccagatcgtgaaggagatcgccgagacccagcacggcaccatcgtgatcagggtgcagtacgagggcaccgacgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcatcatcggcgtggagcccggccagctgaagctgcactggttcaagaagggcagcagcatcggcaagatgttcgaggccaccgccaggggcgccaagaggatggccatcctgggcgagaccgcctgggacttcggcagcgtgggcggcctgctgaccagcctgggcaagatggtgcaccagatcttcggcagcgtgtacaccaccatgttcggc

SEQ ID NO: 166 - DNA, 1323 bp, Artificial Sequence
  Synthetic polynucleotide: 14E9 Round II shuffled clone
atgaccgtgttcttcatcctgctgatgctggtgaccccctctatggccatgaggtgcgtgggcatcggcaaccgcgacttcgtggagggcgtgagcggcggcgcctgggtggacctggtgctggagcacggcggctgcgtgaccaccatggccaagaacaagcccaccctggacatcgagctgatcaagaccgaggccacccagcccgccaccctgaggaagtactgcatcgaggccaagatcaccaacatcaccaccgacagcaggtgccccacccagggcgaggccatcctgcccgaggagcaggaccagcagtacatctgcaggagggacgtggtggacaggggctggggcaacggctgcggcctgttcggcaagggcagcgtggtgacctgcgccaagttccagtgcgtgaccaagctggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgatgaagatgaagaacaaggcctggatggtgcacaagcagtggttcctggacctgcccctgccctggaccagcggcgccagcaccagccaggagacctggaacaggaaggagctgctggtgaccttcaagaacgcccacgccaagaagcaggaggtggtggtgctgggcagccaggagggcgccatgcacagcgccctggccggcgccaccgagatccagatgagcagcggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgcctacacc

SEQ ID NO: 167 - DNA, 1386 bp, Artificial Sequence
  Synthetic polynucleotide: 13E11 Round II shuffled clone
atgaccgtgttcttcatcctgatgatgctggtgaccccctctatggccatgaggtgcgtgggcgtgggcaacagggacttcgtggagggcgtgagcggcggcgcctgggtggacgtggtgctggagcacggcggctgcgtgaccaccatggccaagaacaagcccaccctggacatcgagctgatcaagaccgaggccacccagcccgccaccctgaggaagtactgcatcgaggccagcatcagcaacatcaccaccgacaccaggtgccccacccagggtgagccctacctgaaggaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcaccgtgaccatggagtgcagccccaggaccggcctggacttcaacgagatgatcctgctgaccatgaagagcaagacctggctagtgcacaagcagtggttcctggacctgcccctgccctggaccgccggcgccgacaccgagacccccacctggaacaggaaggagctgctggtgaccttcaagaacgcccacgccaagaagcaggaggtggtggtgctgggcagccaggagggcgccatgcacaccgccctggccggcgccaccgagatccagatgagcagcggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcgtgatcagggtgcagtacgagggcaccgacgccccctgcaagatccccttcagcaccgaggacggccagggcaaggcccacaacggcaggctgatcaccgccaaccccatcgtgatcgacaaggagaagcccgtgaacatcgagctggagccccccttcggcgagagctacatcgtggtgggcgccggcgagaaggccctgaccctgcactggttcaggaagggcagcagcatcggccagatgttcgagaccaccatgaggggcgccaagaggatggccatcttgggcgagaccgcctgggacttcggcagcgtgggcggcgtgttcaccagcatcggcaaggccctgcaccaggtgttcggcgccatctacggcgcc

SEQ ID NO: 168 - DNA, 1380 bp, Artificial Sequence
  Synthetic polynucleotide: 16E8 Round II shuffled clone
atgaccgtgttcttcatcctgatgatgctggtggccccctcctacggcatgaggtgcgtgggcgtgggcaacagggacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaagcagtggttcctggacctgcccctgccctggaccagcggcgccaccaccgagacccccacctggaacaggaaggagctgctggtgaccttcaagaccgcccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcctgatcaaggtggagtacaagggcgaggacgccccctgcaagatccccttcagcaccgaggacggccagggcaaggcccacaacggcaggctgatcaccgccaaccccatcgtgatcgacaaggagaagcccgtgaacatcgaggccgagccccccttcggcgagagcaacatcgtgatcggcatcggcgacaaggccctgaagatcaactggtacaagaagggcagcagcatcggcaagatgttcgagaccaccatgaggggcgccaagaggatggccatcttgggcgacaccgcctgggacttcggcagcgtgggcggcgtgttcaccagcatcggcaaggccctgcaccaggtgttcggcgccatctacggcgcc

SEQ ID NO: 169 - DNA, 1389 bp, Artificial Sequence
  Synthetic polynucleotide: 16E10 Round II shuffled clone
atgaccgtgttcttcatcctgatgatgctggtggccccctcctacggcatgaggtgcatcggcatcagcaacagggacttcgtggagggcgtgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaaaatcagcaacaccaccaccgacagcaggtgccccacccagggcgaggccaccctggtggaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcatcaccgtgcacaccggcgaccagcaccaggtgggcaacgacacccagggcgtgaccgtggagatcaccccccaggccagcaccgtggaggccatcctgcccgagtacggcgccctgggcctggagtgcagccccaggaccggcctggacttcaacgagatgatcctgctgaccatgaagaacaaggcctggatggtgcacgggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacagcgccctggccggcgccaccgagatccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgatcgacaaggagaagcccgtgaacatcgaggccgagccccccttcggcgagagctacatcgtggtcggcgtgggcgacagcgccctgaccctgcactggttcaggaagggcagcagcatcggccagatgttcgagaccaccatgaggggcgccaagaggatggccatcttgggcgacaccgcctgggacttcggcagcgtgggcggcgtgctgaacagcctgggcaagatggtgcaccagatcttcggcagcgtgtacaccaccatgttcggc

SEQ ID NO: 170 - DNA, 1389 bp, Artificial Sequence
  Synthetic polynucleotide: 18E9 Round II shuffled clone
atgaccgtgttcttcatcctgatgatgctggtggccccctcctacggcatgaggtgcgtgggcgtgggcaacagggacttcgtggagggcctgagcggcgccacctgggtggacgtggtgctggagcacggcggctgcgtgaccaccatggccaagaacaagcccaccctggacttcgagctgatcaagaccgaggccacccagcccgccaccctgaggaagtactgcatcgaggccaagctgaccaataccaccaccgccaccaggtgccccacccagggcgagccctacctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacagcgtgatcgtgaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagagctggctggtgcacaagcagtggttcctggacctgcccctgccctggaccagcggcgccagcaccagccaggagacctggaacaggaaggagctgctggtgaccttcaagaacgcccacgccaagaggcaggacgtgaccgtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcagccaggacgagaagggcgtgacccagaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgacaccgcctgggacttcggcagcgtgggcggcgtgctgaacagcctgggcaagatggtgcaccagatcttcggcagcgtgtacaccaccatgttcggc

SEQ ID NO: 171 - DNA, 1395 bp, Artificial Sequence
  Synthetic polynucleotide: 18E10 Round II shuffled clone
atgaccgtgttcttcatcctgctgatgctggtgaccccctctatggccatgaggtgcgtgggcgtgggcaacagggacttcgtggagggcctgagcggcgccacctgggtggacgtggtgctggagcacggcggctgcgtgaccaccatggccaagaacaagcccaccctggacatcgagctgcagaagaccgaggccacccagctggccaccctgaggaagtactgcatcgaggccaagctgaccaataccaccaccgagagcaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggccagatgttcgagaccaccatgaggggcgccaagaggatggccatcttgggcgacaccgcctgggacttcggcagcgtgggcggcctgctgaccagcctgggcaaggccgtgcaccaggtgttcggcagcgtgtacaccaccatgttcggc

SEQ ID NO: 172 - DNA, 1380 bp, Artificial Sequence
  Synthetic polynucleotide: 18E11 Round II shuffled clone
atgaccgtgttcttcatcctgatgatgctggtggccccctcctacggcatgaggtgcgtgggcgtgggcaacagggacttcgtggagggcctgagcggcgccacctgggtggacgtggtgctggagcacggcggctgcgtgaccaccatggccaagaacaagcccaccctggacttcgagctgatcaagaccaccgtcaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcctgatcaaggtggagtacaagggcgaggacgccccctgcaagatccccttcagcaccgaggacgagaagggcaaggcccacaacggcaggctgatcaccgccaaccccatcgtgatcgacaaggagaagcccgtgaacatcgaggccgagccccccttcggcgagagctacatcgtggtgggcgccggcgacaaggccctgaagctgagctggttcaagaagggcagcagcatcggccagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 173 - DNA, 1380 bp, Artificial Sequence
  Synthetic polynucleotide: 11B1 Round II shuffled clone
atggtggtgatcttcatcctgctgatgctggtgaccccctccatgacaatgaggtgcatcggcatcagcaacagggacttcgtggagggcgtgagcggcgccacctgggtggacgtggtgctggagcacggcagctgcgtgaccaccatggccaagaacaagcccaccctggacatcgagctgatcaagaccgaggccacccagcccgccaccctgaggaagtactgcatcgaggccaagctgaccaataccaccaccgccaccaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgatacccagggcgtgaccgtggagatcaccccccaggccagcaccgtggaggccatcctgcccgagtacggcaccctgggcctggagtgtagccccaggaccggcctggacttcaacgagatgatcctgctgaccatgaagaacaaggcctggatggtgcacaggcagtggttcttcgacctgcccctgccctggaccagcggcgccaccaccgagacccccacctggaaccacaaggagaggatggtgaccttcaaggtgccccacgccaagaggcaggacgtgaccgtgctgggcagccaggagggcgccatgcacaccgccctgaccggcgccaccgaggtggacagcggcgacggcaaccacatgttcgccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgccaaccccatcgtgaccgagaaggacagccccgtgaacatcgaggccgagccccccttcggcgacagctacatcatcatcggcgtggagcccggccagctgaagctgcactggttcaggaagggcagcagcatcggccagatgttcgagagcacctacaggggcgccaagaggatggccatcctgggcgagaccgcctgggacttcggcagcgtgggcggcctgctgaccagcctgggcaaggccgtgcaccaggtgttcggcgccatctacggcgcc

SEQ ID NO: 174 - DNA, 1389 bp, Artificial Sequence
  Synthetic polynucleotide: 11B8 Round II shuffled clone
atgaccgtgttcttcatcctgctgatgctggtggccccctcctacggcatgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagctgaccaataccaccaccgagagcaggtgccccacccagggcgagccctacctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacagggtggtgctgctgaccatgaagaagaagacctggctggtgcacaagcagtggttcctggacctgcccctgccctggaccgccggcgccgacaccgagacccccacctggaacaggaaggagctgctggtgaccttcaagaacgcccacgccaagaagcaggaggtggtggtgctgggcagccaggagggcgccatgcacagcgccctggccggcgccaccgagatccagatgagcagcggcaaccacatgttcgccggccacctgaagtgcaaggtgaggatggagaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggccagatgttcgaggccaccgccaggggcgccaggaggatggccatcctgggcgacaccgcctgggacttcggcagcgtgggcggcctgctgaccagcctgggcaagatggtgcaccagatcttcggcagcgtgtacaccaccatgttcggc

SEQ ID NO: 175 - DNA, 1329 bp, Artificial Sequence
  Synthetic polynucleotide: 11C4 Round II shuffled clone
atgaccgtgttcttcatcctgatgatgctggtggccccctcctacggcatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggacctactgcatcgaggccagcatcagcaacatcaccaccgagagcaggtgccccacccagggcgagccctacctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatgatcctgctgaccatgaagagcaagacctggctggtgcacaagcagtggttcctggacctgcccctgccctggaccgccggcgccgacaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtgggcgacaaggccctgaagctgcactggttcaagaagggcagcagcatcggcaagatgttcgaggccaccgccaggggcgccaagaggatggccatcctgggcgagaccgcctgggacttcggcagcgcctacacc

SEQ ID NO: 176 - DNA, 1380 bp, Artificial Sequence
  Synthetic polynucleotide: 11C11 Round II shuffled clone
atgaccgtgttcttcatcctgatgatgctggtggccccctcctacggcatgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgagagcaggtgccccacccagggcgagccctacctgaaggaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagacctggctggtgcacaagcagtggttcctggacctgcccctgccctggaccgccggcgccgacaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgaggacgccccctgcaagatccccttcagcaccgaggacggccagggcaaggcccacaacggcaggctgatcaccgccaaccccatcgtgaccgagaaggacagccccgtgaacatcgaggccgagccccccttcggcgacagctacatcgtggtgggcgccggcgagaaggccctgaagctgcactggttcaagaagggcagcagcatcggccagatgttcgaggccaccgccaggggcgccaggaggatggccatcctgggcgacaccgcctgggacttcggcagcgtgggcggcgtgttcaccagcatcggcaaggccctgcaccaggtgttcggcgccatctacggcgcc

SEQ ID NO: 177 - DNA, 1323 bp, Artificial Sequence
  Synthetic polynucleotide: 12H4 Round II shuffled clone
atgaccgtgttcttcatcctgatgatgctggtggccccctcctacgccatgaggtgcatcggcatcagcaacagggacttcgtggagggcgtgagcggcgccacctgggtggacgtggtgctggagcacggcagctgcgtgaccaccatggccaagaacaagcccaccctggacatcgagctgatcaagaccgaggccacccagcccgccaccctgaggaagtactgcatcgaggccagcatcagcaacatcaccaccgacagcaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagagctggctggtgcacaagcagtggttcctggacctgcccctgccctggaccgccggcgccgacaccgagacccccacctggaacaggaaggagctgctggtgaccttcaagaacgcccacgccaagaagcaggaggtggtggtgctgggcagccaggagggcgccatgcacaccgccctgaccggcgccaccgagatccagatgagcagcggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacgagaagggcgtgacccagaacggcaggctgatcaccgccaaccccatcgtgaccgagaaggacagccccgtgaacatcgaggccgagccccccttcggcgacagctacatcatcatcggtgtggagcccggccagctgaagctgcactggttcaagaagggcagcagcatcggccagatgttcgaggccaccgccaggggcgccaggaggatggccatcctgggcgacaccgcctgggacttcggcagcgcctacacc

SEQ ID NO: 178 - DNA, 1386 bp, Artificial Sequence
  Synthetic polynucleotide: 13F11 Round II shuffled clone
atgaccgtgttcttcatcctgatgatgctggtgaccccctctatggccatgaggtgcgtgggcatcggcaaccgcgacttcgtggagggcgtgagcggcggcgcctgggtggacctggtgctggagcacggcggctgcgtgaccaccatggccaagaacaagcccaccctggacatcgagctgatcaagaccgaggccacccagcccgccaccctgaggaagtactgcatcgaggccaagatcaccaacatcaccaccgacagcaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacgagaagggcaaggcccacaacggcaggctgatcaccgccaaccccatcgtgatcgacaaggagaagcccgtgaacatcgagctggagccccccttcggcgagagctacatcgtggtgggcgccggcgagaaggccctgaagctgagctggttcaagaagggcagcagcatcggcaagatgttcgagagcacctacaggggcgccaagaggatggccatcctgggcgacaccgcctgggacttcggcagcgtgggcggcgtgttcaccagcatcggcaaggccctgcaccaggtgttcggcgccatctacggcgcc

SEQ ID NO: 179 - DNA, 1323 bp, Artificial Sequence
  Synthetic polynucleotide: 14B1 Round II shuffled clone
atgaccgtgttcttcatcctgatgatgctggtggccccctcctacggcatgaggtgcgtgggcatcagcaacagggacttcgtggagggcgtgagcggcggcgcctgggtggacctggtgctggagcacggcggctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctgaagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagagctggctggtgcacaagcagtggttcctggacctgcccctgccctggaccgccggcgccgacaccgagacccccacctggaacaggaaggagctgctggtgaccttcaagaacgcccacgccaagaggcaggacgtgaccgtgctgggcagccaggagggcgccatgcacagcgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcgtgatcagggtgcagtacgagggcgacggcgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcgccggcgagaaggccctgaagctgagctggttcaagaagggcagcagcatcggccagatgttcgagagcaccgccaggggcgccaggaggatggccatcctgggcgacaccgcctgggacttcggcagcgcctacacc

SEQ ID NO: 180 - DNA, 1386 bp, Artificial Sequence
  Synthetic polynucleotide: 14G10 Round II shuffled clone
atggccgtgttcttcatcctgctgatgctggtgaccccctctatggcaatgaggtgcatcggcatcagcaacagggacttcgtggagggcgtgagcggcgccacctgggtggacgtggtgctggagcacggcggctgcgtgaccaccatggccaagaacaagcccaccctggacatcgagctgctgaagaccgaggtgaccaaccccgccaccctgaggaagtactgcatcgaggccaagatcaccaacatcaccaccgacaccaggtgccccacccagggcgaggccatcctgcccgaggagcaggaccagcagtacatctgcaggagggacgtggtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacagcggcgaggagcacgccgtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgagatccagatgagcagcggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 181 - DNA, 1380 bp, Artificial Sequence
  Synthetic polynucleotide: 14H2 Round II shuffled clone
atgaccgtgttcttcatcctgatgatgctggtggccccctcctacggcatgaggtgcgtgggcgtgggcaacagggacttcgtggagggcgtgagcggcggcgcctgggtggacctggtgctggagcacggcggctgcgtgaccaccatggccaagaacaagcccaccctggacttcgagctgatcaagaccaccgccaaggaggtggccctgctgaggacctactgcatcgaggccaagatcaccaacatcaccaccgccaccaggtgccccacccagggcgagccctacctgaaggaggagcaggaccagaactacgtgtgcaagcacacctacgtggacaggggctggggcaacggctgcggcctgttcggcaagggcagcctgatcacctgcgccaagttccagtgcgtgaccaagctggagggcaacatcgtgcagcccgagaacctggagtacaccatcgtgatcaccccccacagcggcgaggagcacgccgtgggcaacgacacccagggcgtgaccgtggagatcaccccccaggccagcaccgtggaggccatcctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacaagggcgaggacgccccctgcaagatccccttcagcagccaggacggccagggcaaggcccacaacggcaggctgatcaccgccaaccccatcgtgaccgagaaggacagccccgtgaacatcgaggccgagccccccttcggcgagagctacatcgtggtgggcgccggcgagaaggccctgaagctgagctggttcaagaagggcagcagcatcggccagatgttcgagaccaccatgaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 182 - DNA, 1389 bp, Artificial Sequence
  Synthetic polynucleotide: 15C2 Round II shuffled clone
atggtggtgatcttcatcctgctgatgctggtgaccccctctatggccatgaggtgcgtcggcatcagcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgagccctacctgaaggaggagcaggaccagcagtacatctgcaggagggacgtggtggacaggggctggggcaacggctgcggcctgttcggcaagggcagcgtggtgacctgcgccaagttccagtgcctggagcccatcgagggcaagatcgtgcagtacgagaacctgaagtacagcgtgatcgtgaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaggctgaagatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacgagaagggcgtgacccagaacggcaggctgatcaccgccaaccccatcgtgatcgacaaggagaagcccgtgaacatcgaggccgagccccccttcggcgagagctacatcgtcatcggcgtggagcccggccagctgaagctgcactggttcaagaagggcagcagcatcggccagatgttcgaggccaccgccaggggcgccaggaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 183 - DNA, 1386 bp, Artificial Sequence
  Synthetic polynucleotide: 15D4 Round II shuffled clone
atgaccgtgttcttcatcctgctgatgctggtgaccccctctatggccatgaggtgcgtgggcatcggcaaccgcgacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcctggagcccatcgagggcaaggtggtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacagcgccctggccggcgccaccgagatccagatgagcagcggcaacctgctgttcaccggccacctgaagtgcaggctgaggatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcgccggcgacaaggccctgaagatcaactggtacaagaagggcagcagcatcggcaagatgttcgagagcacctacaggggcgccaagaggatggccatcttgggcgacaccgcctgggacttcggcagcctgggcggcgtgttcaccagcatcggcaaggccctgcaccaagtgttcggcgccatctacggcgcc

SEQ ID NO: 184 - DNA, 1389 bp, Artificial Sequence
  Synthetic polynucleotide: 15H4 Round II shuffled clone
atgaccgtgttcttcatcctgatgatgctggtggccccctcctacggcatgaggtgcgtgggcgtgggcaacagggacttcgtggagggcctgagcggcgccacctgggtggacgtggtgctggagcacggcagctgcgtgaccaccatggccaagaacaagcccaccctggacttcgagctgatcaagaccgaggtgaccaaccccgccaccctgaggaagtactgcatcgaggccagcatcagcaacatcaccaccgccaccaggtgccccacccagggcgaggccaacctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggaggtggtggtgctgggcagccaggagggcgccatgcacagcgccctggccggcgccaccgagatccagatgagcagcggcaacctgctgttcaccggccgcctgaagtgcaggctgaagatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccctggagatcatggacctggagaagaggcacgtgctgggcaggctgatcaccgtgaaccccatcgtgatcgacaaggagaagcccgtgaacatcgaggccgagcccccctttggcgacagctacatcatcatcggcgtggagcccggccagctgaagctgcactggttcaagaagggcagcagcatcggccagatgttcgagagcacctacaggggcgccaagaggatggccatcctgggcgacaccgcctgggacttcggcagcgtgggcggcgtgctgaacagcctgggcaagatggtgcaccagatcttcggcagcgtgtacaccaccatgttcggc

SEQ ID NO: 185 - DNA, 1392 bp, Artificial Sequence
  Synthetic polynucleotide: 16B4 Round II shuffled clone
atgggcatcatcttcatcctgctgatgctggtgaccccctcctacggcatgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagacctggctggtgcacaagcagtggttcctcgacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaccaccaccatcttcgccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtcggcgtgggcgacaaggccctgaagatcaactggtacaagaagggcagcagcatcggccagatgttcgagaccaccatgaggggcgccaagaggatggccatcctgggcgacaccgcctgggacttcggcagcgtgggcggcctgctgaccagcctgggcaagatggtgcaccagatcttcggcagcgtgtacaccaccatgttcggc

SEQ ID NO: 186 - DNA, 1380 bp, Artificial Sequence
  Synthetic polynucleotide: 16F12 Round II shuffled clone
atgaccgtgttcttcatcctgatgatgctggtggccccctcctacggcatgaggtgcgtgggcgtgggcaacggggacttcgtggagggcctgagcggcgccacctgggtggacgtggtgctggagcacggcagctgcgtgaccaccatggccaagaacaagcccaccctggacttcgagctgatcaagaccatcgccaaggaggtggccctgctgaggacctactgcatcgaggccagcatcagcaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccgaggtgcactggaaccacaaggagaggatggtgaccttcaagaccgcccacgccaagaagcaggacgtggtggtgctgggcagccaggagggcaccatgcacaccgccctgaccggcgccaccgagatccagatgagcagcggcaccaccaccatcttcgccggccacctgaagtgcaaggtgaagatggacaagctgcagctgaagggcatgagctacaccatgtgcaccggcaagttccagatcgtgaaggagatcgccgagacccagcacggcaccatcgtgatcagggtgcagtacgagggcgacggcgccccctgcaagatccccctggagatcatggacctggagaagaggcacgtgctgggcaggctgatcaccgtgaaccccatcgtgatcgacaaggagaagcccgtgaacatcgaggccgagccccccttcggcgagagctacatcgtggtcggcgtgggcgacagcgccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 187 - DNA, 1389 bp, Artificial Sequence
  Synthetic polynucleotide: 16G11 Round II shuffled clone
atgggcatcatcttcatcctgctgatgctggtgaccccctctatggccatgaggtgcgtgggcatcggcaaccgcgacttcgtggagggcctgagcggcgccacctgggtggacgtggtgctggagcacggcggctgcgtgaccaccatggccaagaacaagcccaccctggacatcgagctgctgaagaccgaggtgaccaaccccgccgtgctgaggaagctgtgcatcgaggccagcatcagcaacaccaccaccgacagcaggtgccccacccagggcgaggccaccctggtggaggagcaggacaccaacttcgtgtgcaggaggaccttcgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgaggccaccgccaggggcgccaggaggatggccatcctgggcgacaccgcctgggacttcggcagcctgggcggcctgctgaccagcctgggcaaggccgtgcaccaggtgttcggcagcgtgtacaccaccatgttcggc

SEQ ID NO: 188 - DNA, 1380 bp, Artificial Sequence
  Synthetic polynucleotide: 17A12 Round II shuffled clone
atgaccgtgttcttcatcctgatgatgctggtgaccccctccatgacaatgaggtgcgtgggcgtgggcaacagggacttcgtggagggcctgagcggcgccacctgggtggacgtggtgctggagcacggcagctgcgtgaccaccatggccaagaacaagcccaccctggacttcgagctgatcaagaccgaggccacccagcccgccaccctgaggaagtactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcctggagcccatcgagggcaaggtggtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaagaagagctggctggtgcacaagcagtggttcctggacctgcccctgccctggaccagcggcgccaccaccgagacccccacctggaacaggaaggagctgctggtgaccttcaagaacgcccacgccaagaggcaggacgtgaccgtgctgggcagccaggagggcgccatgcacagcgccctgaccggcgccaccgagatccagaccagcggcaccaccaccatcttcgccggccacctgaagtgcagggtgaggatggacaagctgcagctgaagggcatgagctacgtgatgtgcaccggcagcttcaagctggagaaggaggtggccgagacccagcacggcaccgtgctggtgcaggtgaagtacgagggcaccgacgccccctgcaagatccccgtcagcagccaggacgagaagggcgtgacccagaacggcaggctgatcaccgccaaccccatcgtgaccgagaaggacagccccgtgaacatcgaggccgagccccccttcggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacctcggcagcgtgggcggcgtgttcaccagcatcggcaaggccctgcaccaggtgttcggcgccatctacggcgcc

SEQ ID NO: 189 - DNA, 1380 bp, Artificial Sequence
  Synthetic polynucleotide: 17D5 Round II shuffled clone
atgaccgtgttcttcatcctgctgatgctggtgaccccctccatgacaatgaggtgcatcggcatcagcaacagggacttcgtggagggcgtgagcggcgccacctgggtggacgtggtgctggagcacggcggctgcgtgaccaccatggccaggaacaagcccaccctggacatcgagctgatcaagaccgaggccacccagcccgccaccctgaggaagtactgcatcgaggccagcatcagcaacatcaccaccgccaccaggtgccccacccagggcgaggccatcctgcccgaggagcaggaccagcagtacatctgcaggagggacgtggtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcgccggcgacaaggccctgaagatcaactggtacaagaagggcagcagcatcggcaagatgttcgagagcacctacaggggcgccaagaggatggccatcttgggcgacaccgcctgggacttcggcagcctgggcggcgtgttcaccagcatcggcaaggccctgcaccaggtgttcggcgccatctacggcgcc

SEQ ID NO: 190 - DNA, 1380 bp, Artificial Sequence
  Synthetic polynucleotide: 17D11 Round II shuffled clone
atgaccgtgttcttcatcctgatgatgctggtggccccctcctacggcatgaggtgcgtgggcaccggcaaccgcgacttcgtggagggcctgagcggcgccacctgggtggacgtggtgctggagcacggcggctgcgtgaccaccatggcccagggcaagcccaccctggacatcgagctgatcaagaccgaggccacccagcccgccaccctgaggaagtactgcatcgaggccaagctgaccaataccaccaccgagagcaggtgccccacccagggcgagccctacctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaagaagagctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcaccgacgccccctgcaagatccccttcagcagccaggacgagaagggcgtgacccagaacggcaggctgatcaccgccaaccccatcgtgaccgagaaggacagccccgtgaacatcgaggccgagccccccttcggcgagagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 191 - DNA, 1389 bp, Artificial Sequence
  Synthetic polynucleotide: 17F5 Round II shuffled clone
atgaccgtgttcttcatcctgatgatgctggtggccccctcctacggcatgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacagcgccctggccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcgtgatcagggtgcagtacgagggcgacgacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtcggcgtgggcgacagcgccctgaccctgcactggttcaggaagggcagcagcatcggccagatgttcgagaccaccatgaggggcgccaagaggatggccatcttgggcgacaccgcctgggacttcggcagcctgggcggcgtgttcaccagcctgggcaaggccgtgcaccagatcttcggcagcgtgtacaccaccatgttcggc

SEQ ID NO: 192 - DNA, 1389 bp, Artificial Sequence
  Synthetic polynucleotide: 17F11 Round II shuffled clone
atggtggtgatcttcatcctgctgatgctggtgaccccctccatgacaatgaggtgcatcggcatcagcaacagggacttcgtggagggcgtgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaagcagtggctcctggacctgcccctgccctggaccgccggcgccgacaccagcgaggtgcactggaaccacaaggagaggatggtgaccttcaaggtgccccacgccaagaagcaggacgtggtggtgctaggcagccaggagggcgccatgcacaccgccctgaccggcgccaccgagatccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccacaacggcaggctgatcaccgccaaccccatcgtgatcgacaaggagaagcccgtgaacatcgagctggagccccccttcggcgacagctacatcgtgatcggcgtgggcgacagcgccctgaccctgcactggttcaggaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 193 - DNA, 1380 bp, Artificial Sequence
  Synthetic polynucleotide: 17G5 Round II shuffled clone
atgaccgtgttcttcatcctgatgatgctggtggccccctctatggccatgaggtgcgtgggcatcggcaaccgcgacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgaggccatcctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaagaccgcccacgccaagaagcaggaggtggtggtgctgggcagccaggagggcgccatgcacagcgccctggccggcgccaccgaggtggacagcggcgacggcaaccacatgttcgccggccacctgaagtgcaaggtgaggatggacaagctgaccctgaagggcgtgagctacgtgatgtgcaccggcagcttcaagctggagaaggagatcgccgagacccagcacggcaccatcctgatcaaggtggagtacaagggcgaggacgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 194 - DNA, 1344 bp, Artificial Sequence
  Synthetic polynucleotide: 17H3 Round II shuffled clone
atggtggtgatcttcatcctgctgatgctggtgaccccctccatgacaatgaggtgcatcggcatcagcaacagggacttcgtggagggcgtgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaagaagacctggatggtgcacaggcagtggttcttcgacctgcccctgccctggaccgccggcgccgacaccagcgaggtgcactggaaccacaaggagaggatggtgaccttcaagaccgcccacgccaagaggcaggacgtgaccgtgctgggcagccaggagggcgccatgcacagcgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcaccgaggacggccagggcaaggcccacaacggcaggctgatcaccgccaaccccgcggtgaccgacaaggagaagcccgtgaacatcgagctggagccccccttcggcgacagctacatcgtggtgggcgccggcgacaaggccctgaagctgagctggttcaagaagggcagcagcatcggccagatgttcgagagcacctacaggggcgccaagaggatggccatcctgggcgagaccgcctgggacctgggcagcatcggcggcgtgttcaccagcgtgggcaag

SEQ ID NO: 195 - DNA, 1389 bp, Artificial Sequence
  Synthetic polynucleotide: 17H10 Round II shuffled clone
atggtggtgatcttcatcctgctgatgctggtgaccccctccatgacaatgaggtgcatcggcatcagcaacagggacttcgtggagggcgtgagcggcggcagctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccatcatgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaacaaggcctggatggtgcacaggcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgaggccaccgccaggggcgccaggaggatggccatcctgggcgacaccgcctgggacttcggcagcgtgggcggcgtgctgaccagcctgggcaagatggtgcaccagatcttcggcagcgtgtacaccaccatgttcggc

SEQ ID NO: 196 - DNA, 1395 bp, Artificial Sequence
  Synthetic polynucleotide: 17H12 Round II shuffled clone
atggtggtgatcttcatcctgctgatgctggtgaccccctccatgacaatgaggtgcgtgggcgtgggcaacagggacttcgtggagggcctgagcggcgccacctgggtggacgtggtgctggagcacggcagctgcgtgaccaccatggcccagggcaagcccaccctggacatcgagctgctgaagaccgaggtgaccaaccccgccaccctgaggaagtactgcatcgaggccaagctgaccaataccaccaccgagagcaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcaaggtggagtacaagggcgaggacgccccctgcaagatccccttcagcaccgaggacggccagggcaaggcccacaacggcaggctgatcaccgccaaccccatcgtgatcgacaaggagaagcccgtgaacatcgaggccgagccccccttcggcgagagctacatcgtggtgggcgccggcgagaaggccctgaagctgagctggttcaagaagggcagcagcatcggccagatgttcgagaccaccatgaggggcgccaagaggatggccatcctgggcgacaccgcctgggacttcggcagcgtgggcggcctgctgaccagcctgggcaagatggtgcaccagatcttcggcagcgtgtacaccaccatgttcggc

SEQ ID NO: 197 - DNA, 1389 bp, Artificial Sequence
  Synthetic polynucleotide: 18A9 Round II shuffled clone
atgaccgtgttcttcatcctgctgatgctggtgaccccctctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgccaccaggtgccccacccagggcgaggccatcctgcccgaggagcaggaccagaactacgtgtgcaagcacagcatggtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaacaaggcctggatggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgagatccagatgagcagcggcaacctgctgttcaccggccacctgaagtgcaggctgaggatggacaagctgaccctgaagggcgtgagctacgtgatgtgcaccggcaagttccagatcgtgaaggagatcgccgagacccagcacggcaccatcgtgatcagggtgcagtacgagggcaccgacgccccctgcaagatccccttcagcagccaggacgagaagggcgtgacccagaacggcaggctgatcaccgccaaccccatcgtgatcgacaaggagaagcccgtgaacatcgagctggagccccccttcggcgacagctacatcgtggtgggcgccggcgacaaggccctgaccctgcactggttcaggaagggcagcagcatcggccagatgttcgagaccaccatgaggggcgccaagaggatggccatcctgggcgacaccgcctgggacttcggcagcgtgggcggcctgctgaccagcctgggcaagatggtgcaccagatcttcggcagcgtgttcaccagcgtgggcaag

SEQ ID NO: 198 - DNA, 1389 bp, Artificial Sequence
  Synthetic polynucleotide: 18B7 Round II shuffled clone
atgaccgtgttcttcatcctgctgatgctggtgaccccctctatggcaatgaggtgcatcggcatcagcaacagggacttcgtggagggcctgagcggcgccacctgggtggacgtggtgctggagcacggcagctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgaggtggacagcggcgacggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccagaacggcaggctgatcaccgccaaccccatcgtgatcgacaaggagaagcccgtgaacatcgaggccgagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 199 - DNA, 1392 bp, Artificial Sequence
  Synthetic polynucleotide: 18D7 Round II shuffled clone
atggtggtgatcttcatcctgctgatgctggtgaccccctccatgacaatgaggtgcatcggcatcagcaacagggacttcgtggagggcgtgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaccaccaccatcttcgccggccacctgaagtgcaggctgaagatggacaagctgcagctgaagggcatgagctacagcatgtgcaccggcaagttccagatcgtgaaggagatcgccgagacccagcacggcaccatcctgatcaaggtgaagtacgagggcaccgacgccccctgcaagatccccttcagcagccaggacgagaagggcgtgacccagaacggcaggctgatcaccgccaaccccatcgtgaccgagaaggacagccccgtgaacatcgaggccgagccccccttcggcgagagctacatcgtggtgggcgccggcgagaaggccctgaagctgagctggttcaagaagggcagcagcatcggccagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 200 - DNA, 1395 bp, Artificial Sequence
  Synthetic polynucleotide: 18H2 Round II shuffled clone
atgaccgtgttcttcatcctgatgatgctggtggccccctcctacggcatgaggtgcgtgggcgtgggcaacagggacttcgtggagggcgtgagcggcggcgcctgggtggacctggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacaccagcaaccacggcgtgaccgtggagatcaccccccaggccagcaccgtggaggccatcctgcccgagtacggcaccctgggcctggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaaggtgccccacgccaagaagcaggacgtggtggtgctgggcagccaggagggcgccatgcacaccgccctggccggcgccaccgagatccagatgagcagcggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgagaccaccatgaggggcgccaagaggatggccatcttgggcgacaccgcctgggacttcggcagcgtgggcggcctgctgaccagcctgggcaagatggtgcaccagatcttcggcagcgtgtacaccaccatgttcggc

SEQ ID NO: 201 - DNA, 2031 bp, Artificial Sequence
  Synthetic polynucleotide: 5/21-D1 Round I shuffled clone extended to C15/full prM/full E
atgagatctgtgaccatgattctcatgctgctgcctactgctctggccttccatctgacaacaagaggtggcgagcctaccctgatcgtgtccaagcaagaacgcggcaagagcctgctgttcaagacttctgcaggggtgaatatgtgcactctcatcgccatggacctgggcgagctgtgtgaggataccatgacctacaagtgtccacggatgaccgaggccgaacccgacgatgtggattgctggtgcaatgcaactgatacttgggtgacctatgggacctgtagccagacaggcgagcataggagggataagaggtccgtcgccctggaccctcacgttggtctgggcctggaaaccagaaccgagacatggatgagctctgagggagcttggaagcagatccagaaggttgagacttgggctctgcgccatccaggctttacagtcattgccctgttcctggctcatgcaattgggacctctattactcagaagggcatcatcttcattctgctcatgctcgtgacaccatctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgatcgacaaggagaagcccgtgaacatcgaggccgagccccccttcggcgagagctacatcgtggtcggcgtgggcgacagcgccctgaccctgcactggttcaggaagggcagcagcatcggccagatgttcgagaccaccatgaggggcgccaagaggatggccatcctcggcgatacagcctgggattttggctcaatcggaggggtgttcaccagcgtgggtaaactgattcatcagattttcggtacagcatatggcgtgctgttttccggcgtctcttggaccatgaagatcggtattggcatcctcctcacatggctgggactgaatagcaggagcacaagcctgagcatgacctgcatcgctgttggcatggtcacactctacctgggtgtgatggttcaggca

SEQ ID NO: 202 - DNA, 2028 bp, Artificial Sequence
  Synthetic polynucleotide: 6E12-D4 Round I shuffled clone extended to C15/full prM/full E
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccagtccggagagagaaggagggagaagaggtccgtcgccctgactcctcactctggtatgggcctggaaaccagagccgagacatggatgagctctgagggagcttggaagcacgcccagagggttgaatcttggattctgcgcaatccacgctttgcactcctggctggcttcatggcttatatgattgggcagactggtattcagaggaccgtcttcttcgttctgatgatgctcgtggcaccatcttacggcatgaggtgcgtgggcgtgggcaacagggacttcgtggagggcgtgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaccaccaccatcttcgccggccacctgaagtgcaaggtgaggatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccatcgtgatcgacaaggagaagcccgtgaacatcgaggccgagcccccctttggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacttcggcagcgtgggcggcctgctgaccagcctgggcaagatggtgcaccagatcttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 203 - DNA, 2031 bp, Artificial Sequence
  Synthetic polynucleotide: 2/7-D1 Round I shuffled clone extended with DEN- 1 to C15/full prM/full E
atgagatctgtgaccatgattctcatgctgctgcctactgctctggccttccatctgacaacaagaggtggcgagcctaccctgatcgtgtccaagcaagaacgcggcaagagcctgctgttcaagacttctgcaggggtgaatatgtgcactctcatcgccatggacctgggcgagctgtgtgaggataccatgacctacaagtgtccacggatgaccgaggccgaacccgacgatgtggattgctggtgcaatgcaactgatacttgggtgacctatgggacctgtagccagacaggcgagcataggagggataagaggtccgtcgccctggaccctcacgttggtctgggcctggaaaccagaaccgagacatggatgagctctgagggagcttggaagcagatccagaaggttgagacttgggctctgcgccatccaggctttacagtcattgccctgttcctggctcatgcaattgggacctctattactcagaagggcatcatcttcattctgctcatgctcgtgacaccatctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgatcaagaccgaggccacccagcccgccaccctgaggaagtactgcatcgaggccaagctgaccaataccaccaccgagagcaggtgccccacccagggcgagccctacctgaaggaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctcggcgatacagcctgggattttggctcaatcggaggggtgttcaccagcgtgggtaaactgattcatcagattttcggtacagcatatggcgtgctgttttccggcgtctcttggaccatgaagatcggtattggcatcctcctcacatggctgggactgaatagcaggagcacaagcctgagcatgacctgcatcgctgttggcatggtcacactctacctgggtgtgatggttcaggca

SEQ ID NO: 204 - DNA, 2025 bp, Artificial Sequence
  Synthetic polynucleotide: 2G11-D4 Round I shuffled clone extended to C15/full prM/full E
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccagtccggagagagaaggagggagaagaggtccgtcgccctgactcctcactctggtatgggcctggaaaccagagccgagacatggatgagctctgagggagcttggaagcacgcccagagggttgaatcttggattctgcgcaatccacgctttgcactcctggctggcttcatggcttatatgattgggcagactggtattcagaggaccgtcttcttcgttctgatgatgctcgtggcaccatcttacggcatgaggtgcgtgggcgtgggcaacagggacttcgtggagggcgtgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacagcgccctggccggcgccaccgagatccagatgagcagcggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcgccggcgagaaggccctgaagctgagctggttcaagaagggcagcagcatcggccagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 205 - DNA, 2043 bp, Artificial Sequence
  Synthetic polynucleotide: 21C1 Shuffled clone (C15/full prM/full E)
atgaacaggaggaggagaactgtgggcgtgattatcatgctgatccctactgctatggccttccatctgacaacaagaaatggcgagcctcacatgatcgtgggcaggcaagagaagggcaagagcctgctgttcaagactgaggacggcgtgaatatgtgcactctcatggccatcgacctgggcgagctgtgtgaggataccgtgacctacaagtgtccactgctggtcaacaccgaacccgaggatatcgattgctggtgcaatctgacttctgcttgggtgacctatgggacctgtaaccaggctggcgagcataggagggataagaggtccgtcgccctggctcctcacgttggtatgggcctggaaaccagaaccgagacatggatgagctctgagggagcttggaagcacgcccagaggatcgagacctggattctgcgccatccaggctttatcatcatggctgccatcctggcttatacaattgggaccactcacttccagagagccctcatcttcattctgctcaccgccgtggcaccatctatgaccatgaggtgcatcggcatcagcaacagggacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcggcgtggtgacctgcgccaagttcaagtgcgtgaccaagctggagggcaagatcgtgcagtacgagaacctggagtacaccgtggtggtgaccgtgcacaacggcgacacccacgccgtgggcaacgacaccagcaaccacggcgtgaccgccaccatcacccccaggagccccagcgtggaggtgaagctgcccgactacggcgagctgaccctggactgcgagcccaggagcggcatcgacttcaacgagatgatcctgatgaagatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaaggtgaggatggacaagctgcagctgaagggcatgagctacagcatgtgcaccggcaagttccagctcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgatcgacaaggagaagcccgtgaacatcgaggccgagccccccttcggcgacagctacatcatcatcggcgtgggcgacagcgccctgaccctgcactggttcaggaagggcagcagcatcggcaagatgttcgagagcacctacaggggcgccaggaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtgccatggttcaggca

SEQ ID NO: 206 - DNA, 2025 bp, Artificial Sequence
  Synthetic polynucleotide: 23C12 Shuffled clone (C15/full prM/Full E)
atgagatctgtgaccatgattctcatgctgctgcctactgctctggccttccatctgacaacaagaggtggcgagcctaccctgatcgtgtccaagcaagaacgcggcaagagcctgctgttcaagactgcttcagggatcaatatgtgcactctcatcgccatggacctgggcgagatgtgtgacgataccgtgacctacaagtgtccacacatcaccgaggtcgaacccgaggatatcgattgctggtgcaatctgacttctacttgggtgacctatgggacctgtaaccaggctggcgagcataggagggataagaggtccgtcgccctggttcctcacgttggtatgggcctggaaaccagaaccgagacatggatgagctctgagggagcttggaagcacgcccagaggatcgagacctggattctgcgccatccaggctttatcatcatggctgccatcctggcttatacaattgggaccactcacttccagagagccctcatcttcattctgctcatgctcgtgacaccatctatgaccatgaggtgcgtgggcgtgggcaacagggacttcgtggagggcctgagcggcgccacctgggtggacgtggtgctggagcacggcggctgcgtgaccaccatggccaagaacaagcccaccctggacatcgagctgcagaagaccgaggccacccagctggccaccctgaggaagctgtgcatcgagggcaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcaggctgaagatggacaagctggagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtggagcccggccagctgaagctgcactggttcaggaagggcagcagcatcggccagatgttcgagaccaccatgaggggcgccaagaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 207 - DNA, 2025 bp, Artificial Sequence
  Synthetic polynucleotide: 23D5 Shuffled clone (C15/full prM/full E)
atgaaaactagcctctgcctgatgatgatgctgcctgctactctggccttccatctgacatcaagagatggcgagcctaggatgatcgtgggcaagaacgaaagagggaagagcctgctgttcaagactgaggacggcgtgaatatgtgcactctcatcgccatggacctgggcgagctgtgtgaggataccatgacctacaagtgtccacggatgaccgaggtcgaacccgaggatatcgattgctggtgcaatctgacttctacttgggtgacctatgggacctgtaaccaggctggcgagcataggagggataagaggtccgtcgccctggctcctcacgttggtatgggcctggacaccagaacccagacatggatgagcgctgagggagcttggaggcaggtcgagaaggttgaaacttgggctctgcgccatccaggctttacaatcctggccctgttcctggctcattacattgggacctctattactcagaagggcatcatcttcattctgctcatgctcgtgacaccatctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccaagatcagcaacaccaccaccgacagcaggtgccccacccagggcgaggccaccctggtggaggagcaggacaccaacttcgtgtgcaggaggaccttcgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaacggcgacacccacgccgtgggcaacgacacccagggcgtgaccgtggagatcaccccccaggcccccaccagcgagatccagctgaccgactacggcgccctgaccctggactgcagccccaggaccggcctggacttcaacagggtggtgctgctgaccatgaagaagaagagctggctggtgcacaagcagtggttcctggacctgcccctgccctggaccagcggcgccagcaccagccaggagacctggaacaggcaggacctgctggtgaccttcaagaccgcccacgccaagaagcaggaggtggtggtgctgggcagccaggagggcgccatgcacaccgccctgaccggcaccaccgagatccagaccagcggcaccaccaccatcttcgccggccacctgaagtgcaggctgaagatggacaagctgaccctgaagggcatgagctacgtgatgtgcaccggcagcttcaagctggagaaggaggtggccgagacccagcacggcaccgtgctggtgcaggtgaagtacgagggcaccggcgccccctgcaaggtgcccatcgagatcagggacgtgaacaaggagaaggtggtgggcaggatcatcagcagcacccccctggccgagaacaccaacagcgtgaccaacatcgagctggagccccccttcggcgacagctacatcgtgatcggcgtgggcgacagcgccctgaccctgcactggttcaggaagggcagcagcatcggcaagatgttcgagagcaccgccaggggcgccaggaggatggccatcctcggcgatacagcctgggattttggctcaatcggaggggtgttcaccagcgtgggtaaactgattcatcagattttcggtacagcatatggcgtgctgttttccggcgtctcttggaccatgaagatcggtattggcatcctcctcacatggctgggactgaatagcaggagcacaagcctgagcatgacctgcatcgctgttggcatggtcacactctacctgggtgtggtggttcaggca

SEQ ID NO: 208 - DNA, 2025 bp, Artificial Sequence
  Synthetic polynucleotide: 23F5 Shuffled clone (C15/fullprM/full E)
atgagatctgccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccagtccggagagagaaggagggagaagaggtccgtcgccctgactcctcactctggtatgggcctggacaccagaacccagacatggatgagcgctgagggagcttggaagcacgcccagagggttgaatcttggattctgcgcaatccacgctttgcactcctggctggcttcatggcttatatgattgggcagactggtattcagaggaccgtcttcttcgttctgatgatgctcgtggcaccatctatggccatgaggtgcgtgggcatcggcaaccgcgacttcgtggagggcctgagcggcggcgcctgggtggacctggtgctggagcacggcggctgcgtgaccaccatggccaagaacaagcccaccctggacttcgagctgatcaagaccgaggccacccagcccgccaccctgaggaagtactgcatcgaggccaagctgaccaataccaccaccgagagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaagacctggctggtgcacaagcagtggttcctggacctgcccctgccctggaccgccggcgccgacacccgcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaggctgaagatggacaagctggagctgaagggcatgagctacagcatgtgcaccggcaagttccggatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgatcgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccaggggcgccaggaggatggccatcctcggcgatacagcctgggattttggctcaatcggaggggtgttcaccagcgtgggtaaactgattcatcagattttcggtacagcatatggcgtgctgttttccggcgtctcttggaccatgaagatcggtattggcatcctcctcacatggctgggactgaatagcaggagcacaagcctgagcatgacctgcatcgctgttggcatggtcacactctacctgggtgtgatggttcaggca

SEQ ID NO: 209 - DNA, 2025 bp, Artificial Sequence
  Synthetic polynucleotide: 23G3 Shuffled clone (C15/fullprM/full E)
atgaaaactagcctctgcctgatgatgatgctgcctgctactctggccttccatctgacaacaagaaatggcgagcctcacatgatcgtgggcaggcaagagaagggcaagagcctgctgttcaagacttctgcaggggtgaatatgtgcactctcatcgccatggacctgggcgagctgtgtgaggataccatgacctacaagtgtccacggatgaccgaggccgaacccgaggatatcgattgctggtgcaatctgacttctacttgggtgacctatgggacctgtacccagtccggagagagaaggagggagaagaggtccgtcgccctgactcctcactctggtatgggcctggaaaccagagccgagacatggatgagctctgagggagcttggaagcagatccagaaggttgagacttgggctctgcgccatccaggctttacagtcattgccctgttcctggctcatgcaattgggacctctattactcagaagggcatcatcttcattctgctcatgctcgtgacaccatctatggccatgaggtgcgtgggcatcggcaaccgcgacttcgtggagggcctgagcggcgccacctgggtggacgtggtgctggagcacggcggctgcgtgaccaccatggccaagaacaagcccaccctggacatcgagctgcagaagaccgaggccacccagctggccaccctgaggaagctgtgcatcgagggcaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacaccgccctgaccggcgccaccgagatccagaccagcggcaccaccaccatcttcgccggccacctgaagtgcaggctgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccatcgtgatcgacaaggagaagcccgtgaacatcgaggccgagccccccttcggcgagagcaacatcgtgatcggcatcggcgacaaggccctgaagatcaactggttcaagaagggcagcagcatcggcaagatgttcgaggccaccgccaggggcgccaggaggatggccatcctcggcgatacagcctgggattttggctcaatcggaggggtgttcaccagcatcggcaaggccctgcaccaggttttcggtgcaatctatggcgcagccttttccggcgtctcttggaccatgaagatcctgatcggggtcatcatcacatggattggaatgaatagcaggagcacaagcctgagcgttagcctcgtcctggttggcgtcatcacactctacctgggtgccatggttcaggca

SEQ ID NO: 210 - DNA, 2025 bp, Artificial Sequence
  Synthetic polynucleotide: 23H7 Shuffled clone (C15/fullprM/full E)
atgaaaactagcctctgcctgatgatgatgctgcctgctactctggccttccatctgacatcaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctgaggcagaacgaacccgacgatgtggattgctggtgcaatgcaactgatacttgggtgacctatgggacctgtagccagacaggcgagcataggagggataagaggtccgtcgccctggaccctcacgttggtctgggcctggaaaccagaaccgagacatggatgagctctgagggagcttggaagcagatccagaaggttgagacttgggctctgcgccatccaggctttacagtcattgccctgttcctggctcatgcaattgggacctctattactcagaagggcatcatcttcattctgctcatgctcgtgacaccatctatgaccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccaagatcagcaacaccaccaccgacagcaggtgccccacccagggcgaggccaccctggtggaggagcaggacaccaacttcgtgtgcaggaggaccttcgtggacaggggctggggcaacggctgcggcctgttcggcaagggcagcctgatcacctgcgccaagttcaagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacagggtggtgctgctgaccatgaagaagaagagctggctggtgcacaagcagtggttcctggacctgcccctgccctggaccagcggcgccagcaccagccaggagacctggaacaggcaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcaccggccacctgaagtgcaggctgaagatggacaagctgaccctgaagggcgtgagctacgtgacgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccaggggcgccaggaggatggccatcctcggcgatacagcctgggattttggctcaatcggaggggtgttcaccagcgtgggtaaactgattcatcagattttcggtacagcatatggcgtgctgttttccggcgtctcttggaccatgaagatcggtattggcatcctcctcacatggctgggactgaatagcaggagcacaagcctgagcatgacctgcatcgctgttggcatggtcacactctacctgggtgccatggttcaggca

SEQ ID NO: 211 - DNA, 1350 bp, Artificial Sequence
  Synthetic polynucleotide: DEN-1 PRM15/tE (truncated envelope) CO (codon optimized) parent
atgggcatcatcttcatcctgctgatgctggtgaccccctctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccaagatcagcaacaccaccaccgacagcaggtgccccacccagggcgaggccaccctggtggaggagcaggacaccaacttcgtgtgcaggaggaccttcgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagagctggctggtgcacaagcagtggttcctggacctgcccctgccctggaccagcggcgccagcaccagccaggagacctggaacaggcaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcaggctgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccatcgtgatcgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccaggggcgccaggaggatggccatcctgggcgacaccgcctgggacctgggcagcatcggcggcgtgttcaccagcgtgggcaag

SEQ ID NO: 212 - DNA, 1386 bp, Artificial Sequence
  Synthetic polynucleotide: DEN-2 PRM15/tE CO parent
atgggcctgatcctgatcctgcagaccgccgtggccccctccatgacaatgaggtgcatcggcatcagcaacagggacttcgtggagggcgtgagcggcggcagctgggtggacatcgtgctggagcacggctcctgcgtgaccaccatggccaagaacaagcccaccctggacttcgagctgatcaagaccgaggccacccagcccgccaccctgaggaagtactgcatcgaggccaagctgaccaataccaccaccgagagcaggtgccccacccagggcgagcccagcctgaacgaggagcaggacaagaggttcgtgtgcaagcacagcatggtggacaggggctggggcaacggctgcggcctgttcggcaagggcggcatcgtgacctgcgccatgttcacctgcaagaagaacatggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatcgtgctgctgcagatggaggacaaggcctggctggtgcacaggcagtggttcctggacctgcccctgccctggctgcccggcgccgacacccagggcagcaaccgtatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacttcggcagcctgggcggcgtgttcaccagcatcggcaaggccctgcaccaggtgttcggcgccatctacggcgcc

SEQ ID NO: 213 - DNA, 1377 bp, Artificial Sequence
  Synthetic polynucleotide: DEN-3 PRM15/tE CO parent
atggtggtgatcttcatcctgctgatgctggtgaccccctccatgacaatgaggtgcgtgggcgtgggcaacagggacttcgtggagggcctgagcggcgccacctgggtggacgtggtgctggagcacggcggctgcgtgaccaccatggccaagaacaagcccaccctggacatcgagctgcagaagaccgaggccacccagctggccaccctgaggaagctgtgcatcgagggcaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcaggctgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcaggctgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccaggggcgccaggaggatggccatcctgggcgacaccgcctgggacttcggcagcgtgggcggcgtgctgaacagcctgggcaagatggtgcaccagatcttcggcagcgcctacacc

SEQ ID NO: 214 - DNA, 1395 bp, Artificial Sequence
  Synthetic polynucleotide: DEN-4 PRM15/tE CO parent
atgaccgtgttcttcatcctgatgatgctggtggccccctcctacggcatgaggtgcgtgggcgtgggcaacagggacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccaggagccccagcgtggaggtgaagctgcccgactacggcgagctgaccctggactgcgagcccaggagcggcatcgacttcaacgagatgatcctgatgaagatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaaggtgaggatggagaagctgcgcatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagggacgtgaacaaggagaaggtggtgggcaggatcatcagcagcacccccctggccgagaacaccaacagcgtgaccaacatcgagctggagccccccttcggcgacagctacatcgtgatcggcgtgggcgacagcgccctgaccctgcactggttcaggaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 215 - DNA, 2031 bp, Artificial Sequence
  Synthetic polynucleotide: DEN-1 \C15/full prM/full E CO parent(wherein a codon encoding a Met amino acid residue is also included as the first codon contiguous and prior to the first codon of the nucleotide sequence encoding C15)
atgagatctgtgaccatgattctcatgctgctgcctactgctctggccttccatctgacaacaagaggtggcgagcctaccctgatcgtgtccaagcaagaacgcggcaagagcctgctgttcaagacttctgcaggggtgaatatgtgcactctcatcgccatggacctgggcgagctgtgtgaggataccatgacctacaagtgtccacggatgaccgaggccgaacccgacgatgtggattgctggtgcaatgcaactgatacttgggtgacctatgggacctgtagccagacaggcgagcataggagggataagaggtccgtcgccctggaccctcacgttggtctgggcctggaaaccagaaccgagacatggatgagctctgagggagcttggaagcagatccagaaggttgagacttgggctctgcgccatccaggctttacagtcattgccctgttcctggctcatgcaattgggacctctattactcagaagggcatcatcttcattctgctcatgctcgtgacaccatctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccaagatcagcaacaccaccaccgacagcaggtgccccacccagggcgaggccaccctggtggaggagcaggacaccaacttcgtgtgcaggaggaccttcgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagagctggctggtgcacaagcagtggttcctggacctgcccctgccctggaccagcggcgccagcaccagccaggagacctggaacaggcaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcaggctgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccatcgtgatcgacaaggagaagcccgtgaacatcgaggccgagccccccttcggcgagagctacatcgtggtgggcgccggcgagaaggccctgaagctgagctggttcaagaagggcagcagcatcggcaagatgttcgaggccaccgccaggggcgccaggaggatggccatcctcggcgatacagcctgggattttggctcaatcggaggggtgttcaccagcgtgggtaaactgattcatcagattttcggtacagcatatggcgtgctgttttccggcgtctcttggaccatgaagatcggtattggcatcctcctcacatggctgggactgaatagcaggagcacaagcctgagcatgacctgcatcgctgttggcatggtcacactctacctgggtgtgatggttcaggca

SEQ ID NO: 216 - DNA, 2043 bp, Artificial Sequence
  Synthetic polynucleotide: DEN-2 \C15/full prM/full E CO parent(a codon encoding a Met residue is also included as the first codon contiguous and prior to the first codon of the nucleotide sequence encoding C15)
atgaacaggaggaggagaactgtgggcgtgattatcatgctgatccctactgctatggccttccatctgacaacaagaaatggcgagcctcacatgatcgtgggcaggcaagagaagggcaagagcctgctgttcaagactgaggacggcgtgaatatgtgcactctcatggccatcgacctgggcgagctgtgtgaggataccatcacctacaagtgtccactgctgaggcagaacgaacccgaggatatcgattgctggtgcaattcaacttctacttgggtgacctatgggacctgtaccaccacaggcgagcataggagggagaagaggtccgtcgccctggttcctcacgttggtatgggcctggaaaccagaaccgagacatggatgagctctgagggagcttggaagcacgcccagaggatcgagacctggattctgcgccatccaggctttatcatcatggctgccatcctggcttatacaattgggaccactcacttccagagagccctcatcttcattctgctcaccgccgtggcaccatctatgaccatgaggtgcatcggcatcagcaacagggacttcgtggagggcgtgagcggcggcagctgggtggacatcgtgctggagcacggctcctgcgtgaccaccatggccaagaacaagcccaccctggacttcgagctgatcaagaccgaggccacccagcccgccaccctgaggaagtactgcatcgaggccaagctgaccaataccaccaccgagagcaggtgccccacccagggcgagcccagcctgaacgaggagcaggacaagaggttcgtgtgcaagcacagcatggtggacaggggctggggcaacggctgcggcctgttcggcaagggcggcatcgtgacctgcgccatgttcacctgcaagaagaacatggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatcgtgctgctgcagatggaggacaaggcctggctggtgcacaggcagtggttcctggacctgcccctgccctggctgcccggcgccgacacccagggcagcaaccgtatccagaaggagaccctggtgaccttcaagaacccccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacttcggcagcctgggcggcgtgttcaccagcatcggcaaggccctgcaccaggttttcggtgcaatctatggcgcagccttttccggcgtctcttggaccatgaagatcctgatcggggtcatcatcacatggattggaatgaatagcaggagcacaagcctgagcgttagcctcgtcctggttggcgtcatcacactctacctgggtgccatggttcaggca

SEQ ID NO: 217 - DNA, 2025 bp, Artificial Sequence
  Synthetic polynucleotide: DEN-3 \C15/full prM/full E CO parent(a codon encoding a Met amino acid residue is also included as the first codon contiguous and prior to the first codon of the nucleotide sequence encoding C15)
atgaaaactagcctctgcctgatgatgatgctgcctgctactctggccttccatctgacatcaagagatggcgagcctaggatgatcgtgggcaagaacgaaagagggaagagcctgctgttcaagactgcttcagggatcaatatgtgcactctcatcgccatggacctgggcgagatgtgtgacgataccgtgacctacaagtgtccacacatcaccgaggtcgaacccgaggatatcgattgctggtgcaatctgacttctacttgggtgacctatgggacctgtaaccaggctggcgagcataggagggataagaggtccgtcgccctggctcctcacgttggtatgggcctggacaccagaacccagacatggatgagcgctgagggagcttggaggcaggtcgagaaggttgaaacttgggctctgcgccatccaggctttacaatcctggccctgttcctggctcattacattgggacctctctgactcagaaggtcgtcatcttcattctgctcatgctcgtgacaccatctatgaccatgaggtgcgtgggcgtgggcaacagggacttcgtggagggcctgagcggcgccacctgggtggacgtggtgctggagcacggcggctgcgtgaccaccatggccaagaacaagcccaccctggacatcgagctgcagaagaccgaggccacccagctggccaccctgaggaagctgtgcatcgagggcaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcaggctgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcaggctgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccaggggcgccaggaggatggccatcctgggcgacaccgcctgggacttcggcagcgtgggcggcgtgctgaacagcctgggcaagatggtgcaccagatcttcggttcagcatataccgcactgttttccggcgtctcttggatcatgaagatcggtatcggggtcctcctcacatggattggactgaatagcaagaatacaagcatgagctttagctgcatcgctattggcatcatcacactctacctgggtgtggtggttcaggca

SEQ ID NO: 218 - DNA, 2031 bp, Artificial Sequence
  Synthetic polynucleotide: DEN-4 \C15/full prM/full E CO parent(a codon encoding Met amino acid residue is also included as the first codon contiguous and prior to the first codon of the nucleotide sequence encoding C15)
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccagtccggagagagaaggagggagaagaggtccgtcgccctgactcctcactctggtatgggcctggaaaccagagccgagacatggatgagctctgagggagcttggaagcacgcccagagggttgaatcttggattctgcgcaatccacgctttgcactcctggctggcttcatggcttatatgattgggcagactggtattcagaggaccgtcttcttcgttctgatgatgctcgtggcaccatcttacggcatgaggtgcgtgggcgtgggcaacagggacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccaggagccccagcgtggaggtgaagctgcccgactacggcgagctgaccctggactgcgagcccaggagcggcatcgacttcaacgagatgatcctgatgaagatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaaggtgaggatggagaagctgcgcatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagggacgtgaacaaggagaaggtggtgggcaggatcatcagcagcacccccctggccgagaacaccaacagcgtgaccaacatcgagctggagccccccttcggcgacagctacatcgtgatcggcgtgggcgacagcgccctgaccctgcactggttcaggaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 219 - DNA, 498 bp, Artificial Sequence
  Synthetic polynucleotide: DEN-1 with rest of CO PRM-encoding sequence
atgagatctgtgaccatgattctcatgctgctgcctactgctctggccttccatctgacaacaagaggtggcgagcctaccctgatcgtgtccaagcaagaacgcggcaagagcctgctgttcaagacttctgcaggggtgaatatgtgcactctcatcgccatggacctgggcgagctgtgtgaggataccatgacctacaagtgtccacggatgaccgaggccgaacccgacgatgtggattgctggtgcaatgcaactgatacttgggtgacctatgggacctgtagccagacaggcgagcataggagggataagaggtccgtcgccctggaccctcacgttggtctgggcctggaaaccagaaccgagacatggatgagctctgagggagcttggaagcagatccagaaggttgagacttgggctctgcgccatccaggctttacagtcattgccctgttcctggctcatgcaattgggacctctattactcag

SEQ ID NO: 220 - DNA, 510 bp, Artificial Sequence
  Synthetic polynucleotide: DEN-2 with rest of CO C15/PRM-encoding sequence
atgaacaggaggaggagaactgtgggcgtgattatcatgctgatccctactgctatggccttccatctgacaacaagaaatggcgagcctcacatgatcgtgggcaggcaagagaagggcaagagcctgctgttcaagactgaggacggcgtgaatatgtgcactctcatggccatcgacctgggcgagctgtgtgaggataccatcacctacaagtgtccactgctgaggcagaacgaacccgaggatatcgattgctggtgcaattcaacttctacttgggtgacctatgggacctgtaccaccacaggcgagcataggagggagaagaggtccgtcgccctggttcctcacgttggtatgggcctggaaaccagaaccgagacatggatgagctctgagggagcttggaagcacgcccagaggatcgagacctggattctgcgccatccaggctttatcatcatggctgccatcctggcttatacaattgggaccactcacttccag

SEQ ID NO: 221 - DNA, 498 bp, Artificial Sequence
  Synthetic polynucleotide: DEN-3 with rest of CO C15/PRM-encoding sequence
atgaaaactagcctctgcctgatgatgatgctgcctgctactctggccttccatctgacatcaagagatggcgagcctaggatgatcgtgggcaagaacgaaagagggaagagcctgctgttcaagactgcttcagggatcaatatgtgcactctcatcgccatggacctgggcgagatgtgtgacgataccgtgacctacaagtgtccacacatcaccgaggtcgaacccgaggatatcgattgctggtgcaatctgacttctacttgggtgacctatgggacctgtaaccaggctggcgagcataggagggataagaggtccgtcgccctggctcctcacgttggtatgggcctggacaccagaacccagacatggatgagcgctgagggagcttggaggcaggtcgagaaggttgaaacttgggctctgcgccatccaggctttacaatcctggccctgttcctggctcattacattgggacctctctgactcag

SEQ ID NO: 222 - DNA, 498 bp, Artificial Sequence
  Synthetic polynucleotide: DEN-4 with rest of CO C15/PRM-encoding sequence
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccagtccggagagagaaggagggagaagaggtccgtcgccctgactcctcactctggtatgggcctggaaaccagagccgagacatggatgagctctgagggagcttggaagcacgcccagagggttgaatcttggattctgcgcaatccacgctttgcactcctggctggcttcatggcttatatgattgggcagactggtattcag

SEQ ID NO: 223 - DNA, 183 bp, Artificial Sequence
  Synthetic polynucleotide: DEN-1 with rest of CO Env-encoding sequence
ctgattcatcagattttcggtacagcatatggcgtgctgttttccggcgtctcttggaccatgaagatcggtattggcatcctcctcacatggctgggactgaatagcaggagcacaagcctgagcatgacctgcatcgctgttggcatggtcacactctacctgggtgtgatggttcaggca

SEQ ID NO: 224 - DNA, 147 bp, Artificial Sequence
  Synthetic polynucleotide: DEN-2 with rest of CO Env-encoding sequence
gccttttccggcgtctcttggaccatgaagatcctgatcggggtcatcatcacatggattggaatgaatagcaggagcacaagcctgagcgttagcctcgtcctggttggcgtcatcacactctacctgggtgccatggttcaggca

SEQ ID NO: 225 - DNA, 150 bp, Artificial Sequence
  Synthetic polynucleotide: DEN-3 with rest of CO Env-encoding sequence
gcactgttttccggcgtctcttggatcatgaagatcggtatcggggtcctcctcacatggattggactgaatagcaagaatacaagcatgagctttagctgcatcgctattggcatcatcacactctacctgggtgtggtggttcaggca

SEQ ID NO: 226 - DNA, 138 bp, Artificial Sequence
  Synthetic polynucleotide: DEN-4 with rest of CO Env-encoding seq
ggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 227 - protein, 677 aa, Dengue virus type 1
  DEN-1 \C15/full prM/full E parent
MRSVTMILMLLPTALAFHLTTRGGEPTLIVSKQERGKSLLFKTSAGVNMCTLIAMDLGELCEDTMTYKCPRMTEAEPDDVDCWCNATDTWVTYGTCSQTGEHRRDKRSVALDPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVIDKEKPVNIEAEPPFGESYIVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQA

SEQ ID NO: 228 - protein, 681 aa, Dengue virus type 2
  DEN-2 \C15/full prM/full E parent
MNRRRRTVGVIIMLIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRIETWILRHPGFIIMAAILAYTIGTTHFQRALIFILLTAVAPSMTMRCIGISNRDFVEGVSGGSWVDIVLEHGSCVTTMAKNKPTLDFELIKTEATQPATLRKYCIEAKLTNTTTESRCPTQGEPSLNEEQDKRFVCKHSMVDRGWGNGCGLFGKGGIVTCAMFTCKKNMEGNIVQPENLEYTIVITPHSGEEHAVGNDTGKHGKEIKITPQSSITEAELTGYGTVTMECSPRTGLDFNEIVLLQMEDKAWLVHRQWFLDLPLPWLPGADTQGSNRIQKETLVTFKNPHAKKQDVVVLGSQEGAMHTALTGATEIQMSSGNLLFTGHLKCRLRMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQA

SEQ ID NO: 229 - protein, 675 aa, Dengue virus type 3
  DEN-3 \C15/full prM/full E parent
MKTSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFSGVSWIMKIGIGVLLTWIGLNSKNTSMSFSCIAIGIITLYLGVVVQA

SEQ ID NO: 230 - protein, 677 aa, Dengue virus type 4
  DEN-4 \C15/full prM/full E parent
MRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPRFALLAGFMAYMIGQTGIQRTVFFVLMMLVAPSYGMRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPLAENTNSVTNIELEPPFGDSYIVIGVGDSALTLHWFRKGSSIGKMFESTYRGAKRMAILGETAWDFGSVGGLLTSLGKAVHQVFGSVYTTMFGGVSWMVRILIGFLVLWIGTNSRNTSMAMSCIAVGGITLFLGFTVHA

SEQ ID NO: 231 - DNA, 1392 bp, Dengue virus type 1
  DEN-1 PRM15/E trunc WT cDNA sequence fragment; Nucleic acids 894-2285 of GenBank Acc. No. AB074761
actgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttgga

SEQ ID NO: 232 - DNA, 1383 bp, Dengue virus type 2
  DEN-2 PRM15/E trunc WT cDNA sequence fragment; Nucleic acids 892-2274 of GenBank Acc. No. NC_001474
gtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattccatggtagacagaggatggggaaatggatgtggattatttggaaaaggaggcatcgtgacctgtgccatgttcacatgcaaaaagaacatggagggaaaaattgtgcagccagaaaacctggaatacactgtcgttataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatgaaagacaaagcttggctggtgcacagacaatggttcctagacctaccgttgccatggctgcccggagcagacacacaaggatcaaattggatacagaaagagacactggtcaccttcaaaaatccccatgcgaaaaaacaggatgttgttgtcttaggatcccaagagggggccatgcatacagcactcacaggggctacggaaatccagatgtcatcaggaaacctgctgttcacaggacatcttaagtgcaggctgagaatggacaaattacaacttaaagggatgtcatactccatgtgcacaggaaagtttaaagttgtgaaggaaatagcagaaacacaacatggaacaatagtcattagagtacaatatgaaggagacggctctccatgcaagaccccttttgagataatggatctggaaaaaagacatgttttgggccgcctgaccacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccattttgggcgacacagcctgggattttggatctctgggaggagtgttcacatcaataggaaaggctctccaccaggtttttggagcaatctacggggct

SEQ ID NO: 233 - DNA, 1371 bp, Dengue virus type 3
  DEN-3 PRM15/E trunc WT cDNA sequence fragment; Nucleic acids 893-2263 of GenBank Acc. No. M25277
gttatttttatactattaatgctggttaccccatccatgacaatgagatgtgtgggagtaggaaacagagattttgtggaaggcctatcgggagctacgtgggttgacgtggtgctcgagcacggtgggtgtgtgactaccatggctaagaacaagcccacgctggacatagagcttcagaagactgaggccactcagctggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagttacggctgagataacatcccaggcatcaaccgctgaagccattttacctgaatatggaaccctcgggctagaatgctcaccacggacaggtttggatttcaatgaaatgattttattgacaatgaagaacaaagcatggatggtacatagacaatggttctttgacttacccctaccatggacatcaggagctacaacaaaaacaccaacttggaacaggaaagagcttcttgtgacatttaaaaatgcacatgcaaaaaagcaagaagtagttgtccttggatcacaagagggagcaatgcatacagcactgacaggagctacagagatccaaacctcaggaggcacaagtatttttgcggggcacttaaaatgtagactcaagatggacaaattgaaactcaaggggatgagctatgcaatgtgcttgaatacctttgtgttgaagaaagaagtctccgaaacgcagcatgggacaatactcattaaggttgagtacaaaggggaacatgcaccctgcaagattcctttctccacggaggatggacaagggaaagctcacaatggcagactgatcacagccaatccagtggtgaccaagaaggaggagcctgtcaacattgaggctgaacctccttttggggaaagtaatatagtaattggaagtggagacaaagccctgaaaatcaactggtacaggaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacaca

SEQ ID NO: 234 - DNA, 1392 bp, Dengue virus type 4; identical to SEQ ID NO: 231
  DEN-4 PRM15/E trunc WT cDNA sequence fragment; Nucleic acids 894-2285 of GenBank Acc. No. M14931

SEQ ID NO: 235 - DNA, 1380 bp, Artificial Sequence
  Synthetic polynucleotide: 18H6 PRM15/tE Round II shuffled clone
atggtggtgatcttcatcctgctgatgctggtgaccccctccatgacaatgaggtgcgtgggcgtgggcaacagggacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaacgcccacgccaagaggcaggacgtgaccgtgctgggcagccaggagggcgccatgcacagcgccctggccggcgccaccgagatccagatgagcagcggcaacctgctgttcaccggccacctgaagtgcaggctgaagatggacaagctgcagctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcaccgaggacggccagggcaaggcccacaacggcaggctgatcaccgtgaaccccatcgtgatcgacaaggagaagcccgtgaacatcgagctggagccccccttcggcgagagctacatcgtggtgggcgccggcgagaaggccctgaagctgagctggttcaagaagggcagcagcatcggcaagatgttcgaggccaccgccaggggcgccaagaggatggccatcctgggcgagaccgcctgggacttcggcagcgtgggcggcctgctgaccagcctgggcaaggccgtgcaccaggtgttcggcgccatctacggcgcc

SEQ ID NO: 236 - protein, 675 aa, Artificial Sequence
  Synthetic polypeptide:  25B6 (C15/full length prM/full length E)
MRSTITLLCLIPTVMAFSLSTRDGEPLMIVAKHERGRPLLFKTTEGINKCTLIAMDLGELCEDTITYKCPLLRQDEPEDIDCWCNATDTWVTYGTCNQAGEHRRDKRSVALTPHSGMGLETRAETWMSSEGAWKQIQKVETWALRHPGFTVIALFLAHAIGTSITQKGIIFILLMLVTPSMAMRCVGVGNRDFVEGLSGATWVDVVLEHGGCVTTMAKNKPTLDIELQKTEATQLATLRKLCIEGKITNITTDSRCPTQGEAILPEEQDQQYICRRDVVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHKQWFLDLPLPWTSGASTSQETWNRQDLLVTFKTAHAKKQEVVVLGSQEGAMHTALTGATEIQMSSGNLLFTGHLKCRLKMDKLELKGMSYAMCLNTFVLKKEVAETQHGTVLVQVKYEGTDAPCKIPFSSQDEKGVTQNGRLITANPIVIDKEKPVNIEAEPPFGESYIVIGIGDKALKINWYKKGSSIGKMFEATARGARRMAILGDTAWDFGSIGGVFTSVGKLIHQIFGTAYGVLFSGVSWTMKIGIGILLTWLGLNSRSTSMSFSCIAIGIITLYLGVVVQA

SEQ ID NO: 237 - protein, 675 aa, Artificial Sequence
  Synthetic polypeptide:  25B10 (C15/full length prM/full length E)
MRSVTMILMLLPTTLAFHLTSRDGEPRMIVAKHERGRPLLFKTTEGINKCTLIAMDLGEMCDDTVTYKCPHITEVEPEDIDCWCNSTSTWVTYGTCNQAGEHRRDKRSVALAPHVGMGLDTRTQTWMSAEGAWKHAQRIETWILRHPGFIIMAAILAYTIGTTHFQRALIFILLTAAAPSMTMRCIGISNRDFVEGVSGGSWVDIVLEHGSCVTTMAKNKPTLDIELLKTEVTNPAVLRKLCIEAKISNTTTDSRCPTQGEATLPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKTAHAKKQEVVVLGSQEGAMHSALAGATEVQMSSGNLLFTGHLKCRLRMDKLQLKGMSYSMCTGKFQIVKEIAETQHGTIVIRVEYKGEDAPCKIPFSTEDGQGKAHNGRLITANPVVTKKEEPVNIEAEPPFGKSNIVIGIGDKALKINWYKKGSSIGKMFEATARGARRMAILGDTAWDFGSIGGVFTSIGKALHQVFGSVYTTMFGGVSWMVRILIGFLVLWIGTNSRSTSLSMTCIAVGMVTLYLGVMVQA

SEQ ID NO: 238 - protein, 677 aa, Artificial Sequence
  Synthetic polypeptide:  25D4 (C15/full length prM/full length E)
MRSVTMILMLLPTALAFHLTTRGGEPTLIVSKQERGKSLLFKTSAGINMCTLIAMDLGEMCDDTVTYKCPHITEVEPEDIDCWCNLTSTWVTYGTCNQAGEHRRDKRSVALVPHVGMGLETRTETWMSSEGAWKHAQRIETWILRHPGFTILALFLAHYIGTSLTQKVVIFILLMLVTPSMTMRCIGISNRDFVEGLSGATWVDVVLEHGSCVTTMAKNKPTLDFELIKTEATQPATLRKYCIEAKLTNITTDSRCPTQGEAILPEEQDQNYVCKHTYVDRGWGNGCGLFGKGSLVTCAKFQCLEPIEGKVVQHENLKYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHTALTGATEIQMSSGNHMFAGHLKCRLRMDKLQLKGMSYSMCTGKFQIVKEIAETQHGTIVIRVQYEGDGSPCKIPLEIMDLEKRHVLGRLITANPVVTKKDSPVNIEAEPPFGDSYIIIGVEPGQLKLHWFKKGSSIGQMFESTYRGAKRMAILGETAWDFGSVGGLLTSLGKAVHQVFGSVYTTMFGGVSWMVRILIGFLVLWIGTNSRNTSMAMSCIAVGGITLFLGFTVQA

SEQ ID NO: 239 - protein, 675 aa, Artificial Sequence
  Synthetic polypeptide:  25E11 (C15/full length prM/full length E)
MKTSLCLMMMLPATLAFHLTSRDGEPRMIVGKNERGKSLLFKTASGINMCTLIAMDLGEMCDDTVTYKCPHITEVEPEDIDCWCNLTSTWVTYGTCTQSGERRREKRSVALTPHSGMGLETRTETWMSSEGAWKQIQKVETWALRHPGFTVIALFLAHAIGTSITQKGIIFILLMLVTPSMAMRCVGVGNRDFVEGLSGATWVDIVLEHGSCVTTMAKNKPTLDFELIKTEATQPATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGALTLDCSPRTGLDFNRVVLLTMKKKSWLVHKQWFLDLPLPWTSGASTSQETWNRQDLLVTFKTAHAKKQEVVVLGSQEGAMHTALTGTTEIQNSGGTSIFAGHLKCRLKMDKLTLKGVSYVMCTGSFKLEKEVSETQHGTILIKVEYKGEDAPCKVPIEIRDVNKEKVVGRIISSTPLAENTNSVTNIELEPPFGDSYIVIGVGDSALTLHWFRKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQA

SEQ ID NO: 240 - protein, 675 aa, Artificial Sequence
  Synthetic polypeptide:  25H4 (C15/full length prM/full length E)
MRSVTMILMLLPTALAFHLTTRGGEPLMIVAKHERGKSLLFKTASGINMCTLIAMDLGEMCDDTVTYKCPRMTEVEPEDIDCWCNLTSTWVTYGTCTTTGEHRREKRSVALVPHVGMGLETRTETWMSSEGAWKQIQKVETWALRHPGFTILALFLAHYIGTSLTQEVVIFILLMLVTPSMAMRCVGIGNRDFVEGLSGATWVDVVLEHGSCVTTMAKNKPTLDIELLKTEVTNPAVLRKLCIEAKISNTTTDSRCPTQGEAILPEEQDQNYVCKHTYVDRGWGNGCGLFGKGSLVTCAKFQCLEPIEGKVVQHENLKYTVIVTVHTGDQHQVGNDTQGVTVEITPQASTVEAILPEYGTLGLECSPRTGLDFNEMILLTMKNKAWMVHKQWFLDLPLPWTSGASTSQETWNRQDLLVTFKTAHAKKQDVVVLGSQEGAMHTALTGATEIQMSSGNLLFTGHLKCRLRMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQA

SEQ ID NO: 241 - protein, 675 aa, Artificial Sequence
  Synthetic polypeptide:  27A11 (C15/full length prM/full length E)
MKTSLCLMMMLPTALAFHLTTRGGEPTLIVSKQERGKSLLFKTSAGVNMCTLIAMDLGELCEDTMTYKCPRMTEAEPDDVDCWCNATDTWVTYGTCSQTGEHRREKRSVALVPHVGMGLETRTETWMSSEGAWKQIQKVETWALRHPGFTVIALFLAHAIGTSITQKGIIFILLMLVTPSMAMRCVGIGNRDFVEGVSGGSWVDIVLEHGSCVTTMAKNKPTLDIELLKTEVTNPAVLRKLCIEAKISNTTTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPDYGELTLDCEPRSGIDFNEMILLTMKNKAWMVHRQWFFDLPLPWTSGATTETPTWNRKELLVTFKNAHAKKQEVVVLGSQEGAMHTALTGTTEIQNSGGTSIFAGHLKCKVRMEKLRIKGMSYTMCSGKFSIDKEMAETQHGTTVVKVKYEGTGAPCKVPIEIRDVNKEKVVGRIISSTPLAENTNSVTNIELEPPFGDSYIVIGVGDSALTLHWFRKGSSIGKMFESTYRGAKRMAILGETAWDFGSVGGLLTSLGKAVHQVFGSVYTTMFGGVSWMVRILIGFLVLWIGTNSRNTSMAMSCIAVGGITLFLGFTVHA

SEQ ID NO: 242 - protein, 677 aa, Artificial Sequence
  Synthetic polypeptide:  27G6 (C15/full length prM/full length E)
MRSTITLLCLIPTVMAFSLSTRDGEPLMIVAKHERGRPLLFKTTEGINKCTLIAMDLGEMCEDTVTYKCPLLVNTEPEDIDCWCNSTSTWVMYGTCSQTGEHRRDKRSVALVPHVGMGLETRTETWMSSEGAWKQIQKVETWALRHPGFTVIALFLAHYIGTSLTQKVVIFILLMLVTPSMTMRCVGIGNRDFVEGLSGATWVDVVLEHGSCVTTMAKNKPTLDIELLKTEVTNPAVLRKLCIEAKISNTTTDSRCPTQGEPYLKEEQDQQYICRRDVVDRGWGNGCGLFGKGSLITCAKFKCVTKLEGKIVQYENLEYTIVITPHSGEEHAVGNDTSNHGVTATITPRSPSVEVKLPGYGTVTMECSPRTGLDFNRVVLLTMKKKSWLVHKQWFLDLPLPWTSGATTETPTWNRKELLVTFKNAHAKRQDVTVLGSQEGAMHSALAGATEVDSGDGNHMFAGHLKCKVRMEKLTLKGVSYVMCTGSFKLEKEVAETQHGTVLVQVKYEGTDAPCKIPFSSQDEKGVTQNGRLITANPVVTKKEEPVNIEAEPPFGESNIVIGVGDSALTLHWFRKGSSIGKMFESTYRGARRMAILGDTAWDFGSVGGLLTSLGKAVHQVFGSVYTTMFGGVSWMVRILIGFLVLWIGTNSRNTSMAMSCIAVGGITLFLGFTVHA

SEQ ID NO: 243 - protein, 675 aa, Artificial Sequence
  Synthetic polypeptide: 28A11 (C15/full length prM/full length E)
MRSTITLLCLIPTVMAFHLTTRNGEPRMIVGKNERGKSLLFKTEDGVNMCTLMAIDLGELCEDTITYKCPLLVNTEPEDIDCWCNLTSTWVTYGTCNQAGEHRRDKRSVALAPHVGMGLETRTETWMSSEGAWKQIQKVETWALRHPGFTILALFLAHAIGTSITQKGIIFILLMLVTPSMAMRCVGIGNRDFVEGLSGATWVDVVLEHGSCVTTMAKNKPTLDIELLKTEVTNPAVLRKLCIEAKITNITTDSRCPTQGEAILPEEQDQNYVCKHSMVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILMKMKKKTWLVHRQWFLDLPLPWTSGASTSQETWNRQDLLVTFKNAHAKKQEVVVLGSQEGAMHTALTGATEIQTSGTTTIFAGHLKCKVRMEKLRIKGMSYTMCSGKFSIDKEMAETQHGTTVVKVKYEGTGAPCKVPIEIRDVNKEKVVGRIISSTPLAENTNSVTNIELEPPFGDSYIVIGVGDSALTLHWFRKGSSIGKMFESTYRGAKRMAILGETAWDFGSVGGLLTSLGKAVHQVFGSVYTTMFGGVSWMVRILIGFLVLWIGTNSRNTSMAMSCIAIGIITLYLGVVVQA

SEQ ID NO: 244 - protein, 676 aa, Artificial Sequence
  Synthetic polypeptide:  28C1 (C15/full length prM/full length E)
MKTSLCLMMMLPATMAFSLSTRDGEPLMIVAKHERGRPLLFKTTEGINKCTLIAMDLGELCEDTMTYKCPLLRQNEPEDIDCWCNSTSTWVTYGTCNQAGEHRRDKRSVALDPHVGLGLETRTQTWMSAEGAWRQVEKVETWALRHPGFTVIALFLAHAIGTSITQKGIIFILLMLVTPSMAMRCVGIGNRDFVEGLSGATWVDVVLEHGGCVTTMAKNKPTLDFELIKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMKLRIKGMSYTMCSGKFSIDKEMAETQHGTTVVKVKYEGTGAPCKVPIEIRDVNKEKVVGRIISSTPLAENTNSVTNIELEPPFGDSYIVIGIGDKALKINWFRKGSSIGKMFEATARGARRMAILGDTAWDFGSVGGLLTSLGKAVHQVFGSVYTTMFGGVSWMVRILIGFLVLWIGTNSRNTSMAMSCIAVGGITLFLGFTVHA

SEQ ID NO: 245 - protein, 675 aa, Artificial Sequence
  Synthetic polypeptide:  28D11(C15/full length prM/full length E)
MRSTITLLCLIPTVMAFSLSTRDGEPLMIVGKNERGKSLLFKTASGINMCTLIAMDLGEMCEDTVTYKCPLLVNTEPEDIDCWCNLTSTWVMYGTCTQAGEHRRDKRSVALAPHVGMGLDTRTQTWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELQKTEATQLATLRKLCIEGKISNTTTDSRCPTQGEATLPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPVVTKKEEPVNIEAEPPFGESNIVIGIGDSALTLHWFRKGSSIGKMFESTYRGAKRMAILGETAWDFGSVGGLLTSLGKAVHQVFGSVYTTMFGGVSWMVRILIGFLVLWIGTNSRNTSMAMSCIAVGVITLYLGAMVQA

SEQ ID NO: 246 - protein, 675 aa, Artificial Sequence
  Synthetic polypeptide:  28E12 (C15/full length prM/full length E)
MKTSLCLMMMLPATLAFHLTSRDGEPRMIVGKNERGKSLLFKTTEGINKCTLIAMDLGEMCEDTVTYKCPLLVNTEPEDIDCWCNLTSTWVTYGTCTTTGEHRREKRSVALDPHVGLGLETRTETWMSSEGAWRQVEKVETWALRHPGFTILALFLAHYIGTSLTQKVVIFILLMLVTPSMTMRCVGAGNRDFVEGLSGATWVDVVLEHGSCVTTMAKNKPTLDFELIKTEATQPATLRKYCIEAKITNITTDSRCPTQGEAILNEEQDKRFVCKHSMVDRGWGNGCGLFGKGGVVTCAMFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVRGSQEGAMHSALAGATEVDSGDGNHMFAGHLKCRLRMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVGDSALTLHWFRKGSSIGKMFESTYRGARRMAILGDTAWDFGSIGGVFTSVGKLIHQIFGTAYGVLFSGVSWTMKIGIGILLTWLGMNSRSTSLSVSLVLVGVITLYLGAMVQA

SEQ ID NO: 247 - protein, 681 aa, Artificial Sequence
  Synthetic polypeptide: 28F9 (C15/full length prM/full length E)
MNRRRRTVGVIIMLIPTAMAFHLTTRNGEPRMIVAKHERGRPLLFKTTEGINKCTLIAMDLGEMCEDTVTYKCPLLVNTEPEDIDCWCNLTSTWVTYGTCSQTGEHRREKRSVALDPHVGLGLETRTETWMNSEGAWKQIQKVETWALRHPGFTVIALFLAHAIGTSITQKGIIFILLMLVAPSYGMRCVGVGNRDFVEGVSGGAWVDLVLEHGGCVTTMAKNKPTLDFELIKTEATQPATLRKYCIEAKLTNTTTDSRCPTQGEPSLKEEQDQQYICRRDVVDRGWGNGCGLFGKGSLVTCAKFQCLEPIEGKVVQHENLKYTVIITVHTGDQHQVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPLAENTNSVTNIELEPPFGDSYIVIGVGDSALTLHWFKKGSSIGKMFEATARGARRMAILGETAWDFGSVGGLLTSLGKAVHQVFGSVYTTMFGGVSWMVRILIGFLVLWIGTNSRNTSMAMSCIAVGGITLFLGFTVHA

SEQ ID NO: 248 - protein, 678 aa, Artificial Sequence
  Synthetic polypeptide: 28H3(C15/full length prM/full length E)
MRPTITLLCLMMMLPATLAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHAQRVESWILRNPRFALLAGFMAYMIGQTGIQRTVFFVLMMLVAPSYGMRCVGVGNRDFVEGLSGATWVDVVLEHGSCVTTMAKNKPTLDIELLKTEVTNPAVLRKYCIEAKLTNTTTESRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNRVVLLTMKNKAWMVHRQWFFDLPLPWTSGATTETPTWNRKELLVTFKNAHAKKQEVVVLGSQEGAMHTALTGATEIQMSSGNLLFTGHLKCRLRMDKLQLKGMSYTMCSGKFQIVKEIAETQHGTIVIRVQYEGDGSPCKIPLEIMDLEKRHVLGRLITVNPIVIDKEKPVNIEAEPPFGDSYIIIGVEPGQLKLHWFKKGSSIGQMFETTMRGAKRMAILGDTAWDFGSLGGVFTSIGKALHQVFGAIYGAAFSGVSWTMKILIGVIITWIGMNSRSTSLSVSLVLVGVITLYLGAMVQA

SEQ ID NO: 249 - protein, 675 aa, Artificial Sequence
  Synthetic polypeptide: 28H9 (C15/full length prM/full length E)
MRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALVPHVGMGLETRTETWMSAEGAWRQVEKVETWALRHPGFTILALFLAHYIGTSLTQKVVIFILLMLVTPSMTMRCVGVGNRDFVEGVSGGSWVDIVLEHGSCVTTMAKNKPTLDFELIKTEATQPATLRKYCIEAKLTNTTTESRCPTQGEPSLNEEQDKRFVCKHSMVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTAGADTSEVHWNHKERMVTFKVPHAKRQDVTVLGSQEGAMHTALTGTTEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFESTYRGAKRMAILGETAWDFGSVGGVLNSLGKMVHQIFGSAYTALFSGVSWTMKILIGVIITWIGMNSRSTSLSVSLVLVGVITLYLGAMVQA

SEQ ID NO: 250 - protein, 675 aa, Artificial Sequence
  Synthetic polypeptide: 16G11-D4(16G11 extended to C15/full length prM/full length E with WT Den-4 E protein residues)
MRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPRFALLAGFMAYMIGQTGIQRTVFFVLMMLVAPSYGMRCVGVGNRDFVEGVSGATWVDVVLEHGGCVTTMAKNKPTLDIELLKTEVTNPAVLRKLCIEASISNTTTDSRCPTQGEATLVEEQDTNFVCRRTFVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWLVHKQWFLDLPLPWTAGADTSEVHWNHKERMVTFKTAHAKKQDVVVLGSQEGAMHTALTGATEIQMSSGNLLFTGHLKCRLRMDKLQLKGMSYVMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFEATARGARRMAILGETAWDFGSVGGLLTSLGKAVHQVFGSVYTTMFGGVSWMVRILIGFLVLWIGTNSRNTSMAMSCIAVGGITLFLGFTVHA

SEQ ID NO: 251 - protein, 675 aa, Artificial Sequence
  Synthetic polypeptide: 16G11-25B10ext (16G11 extended to C15/full length prM/full length E with 25B10 residues of E protein)
MRSVTMILMLLPTTLAFHLTSRDGEPRMIVAKHERGRPLLFKTTEGINKCTLIAMDLGEMCDDTVTYKCPHITEVEPEDIDCWCNSTSTWVTYGTCNQAGEHRRDKRSVALAPHVGMGLDTRTQTWMSAEGAWKHAQRIETWILRHPGFIIMAAILAYTIGTTHFQRALIFILLTAAAPSMTMRCIGISNRDFVEGVSGATWVDVVLEHGGCVTTMAKNKPTLDIELLKTEVTNPAVLRKLCIEASISNTTTDSRCPTQGEATLVEEQDTNFVCRRTFVDRGWGNGCGLFGKGSVVTCAKFQCLEPIEGKVVQHENLKYTVIITVHTGDQHQVGNDTQGVTVEITPQASTVEAILPEYGTLGLECSPRTGLDFNEMILLTMKNKAWLVHKQWFLDLPLPWTAGADTSEVHWNHKERMVTFKTAHAKKQDVVVLGSQEGAMHTALTGATEIQMSSGNLLFTGHLKCRLRMDKLQLKGMSYVMCTGKFQIVKEIAETQHGTIVIRVQYEGDGAPCKIPFSTEDGQGKAHNGRLITANPIVIDKEKPVNIELEPPFGDSYIVVGAGDKALKINWYKKGSSIGKMFEATARGARRMAILGDTAWDFGSIGGVFTSIGKALHQVFGSVYTTMFGGVSWMVRILIGFLVLWIGTNSRSTSLSMTCIAVGMVTLYLGVMVQA

SEQ ID NO: 252 - protein, 675 aa, Artificial Sequence
  Synthetic polypeptide:  18H6-D4 (18H6 extended to C15/full length prM/full length E with WT Den-4 E protein residues)
MRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPRFALLAGFMAYMIGQTGIQRTVFFVLMMLVAPSYGMRCVGVGNRDFVEGVSGATWVDVVLEHGGCVTTMAKNKPTLDFELIKTTAKEVALLRTYCIEASISNITTATRCPTQGEAILPEEQDQNYVCKHTYVDRGWGNGCGLFGKGSLVTCAKFTCKKNMEGNIVQPENLEYTIVITPHTGDQHQVGNDTQGVTVEITPQASTVEAILPEYGTLGLECSPRTGLDFNRVVLLTMKKKSWLVHKQWFLDLPLPWTAGADTSEVHWNHKERMVTFKNAHAKRQDVTVLGSQEGAMHSALAGATEIQMSSGNLLFTGHLKCRLKMDKLQLKGVSYVMCTGSFKLEKEVAETQHGTVLVQVKYEGTDAPCKIPFSTEDGQGKAHNGRLITVNPIVIDKEKPVNIELEPPFGESYIVVGAGEKALKLSWFKKGSSIGKMFEATARGAKRMAILGETAWDFGSVGGLLTSLGKAVHQVFGSVYTTMFGGVSWMVRILIGFLVLWIGTNSRNTSMAMSCIAVGGITLFLGFTVHA

SEQ ID NO: 253 - protein, 675 aa, Artificial Sequence
  Synthetic polypeptide:  18H6-25B10ext (18H6 extended to C15/full length prM/full length E with 25B10 residues of E protein)
MRSVTMILMLLPTTLAFHLTSRDGEPRMIVAKHERGRPLLFKTTEGINKCTLIAMDLGEMCDDTVTYKCPHITEVEPEDIDCWCNSTSTWVTYGTCNQAGEHRRDKRSVALAPHVGMGLDTRTQTWMSAEGAWKHAQRIETWILRHPGFIIMAAILAYTIGTTHFQRALIFILLTAAAPSMTMRCIGISNRDFVEGVSGATWVDVVLEHGGCVTTMAKNKPTLDFELIKTTAKEVALLRTYCIEASISNITTATRCPTQGEAILPEEQDQNYVCKHTYVDRGWGNGCGLFGKGSLVTCAKFTCKKNMEGNIVQPENLEYTIVITPHTGDQHQVGNDTQGVTVEITPQASTVEAILPEYGTLGLECSPRTGLDFNRVVLLTMKKKSWLVHKQWFLDLPLPWTAGADTSEVHWNHKERMVTFKNAHAKRQDVTVLGSQEGAMHSALAGATEIQMSSGNLLFTGHLKCRLKMDKLQLKGVSYVMCTGSFKLEKEVAETQHGTVLVQVKYEGTDAPCKIPFSTEDGQGKAHNGRLITVNPIVIDKEKPVNIELEPPFGESYIVVGAGEKALKLSWFKKGSSIGKMFEATARGAKRMAILGDTAWDFGSIGGVFTSIGKALHQVFGSVYTTMFGGVSWMVRILIGFLVLWIGTNSRSTSLSMTCIAVGMVTLYLGVMVQA

SEQ ID NO: 254 - DNA, 2025 bp, Artificial Sequence
  Synthetic polynucleotide: 16G11-D4 (16G11 extended to C15/full length prM/full length E with WT Den-4 E protein residues)
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccagtccggagagagaaggagggagaagaggtccgtcgccctgactcctcactctggtatgggcctggaaaccagagccgagacatggatgagctctgagggagcttggaagcacgcccagagggttgaatcttggattctgcgcaatccacgctttgcactcctggctggcttcatggcttatatgattgggcagactggtattcagaggaccgtcttcttcgttctgatgatgctcgtggcaccatcttacggcatgaggtgcgtgggcgtgggcaacagggacttcgtggagggcgtgagcggcgccacctgggtggacgtggtgctggagcacggcggctgcgtgaccaccatggccaagaacaagcccaccctggacatcgagctgctgaagaccgaggtgaccaaccccgccgtgctgaggaagctgtgcatcgaggccagcatcagcaacaccaccaccgacagcaggtgccccacccagggcgaggccaccctggtggaggagcaggacaccaacttcgtgtgcaggaggaccttcgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgaggccaccgccaggggcgccaggaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 255 - DNA, 2025 bp, Artificial Sequence
  Synthetic polynucleotide: 16G11-25B10ext (16G11 extended to C15/full length prM/full length E with 25B10 E protein residues)
atgagatctgtgaccatgattctcatgctgctgcctactactctggccttccatctgacatcaagagatggcgagcctaggatgatcgtggccaagcacgaaagagggaggcctctgctgttcaagactactgaagggatcaataagtgcactctcatcgccatggacctgggcgagatgtgtgacgataccgtgacctacaagtgtccacacatcaccgaggtcgaacccgaggatatcgattgctggtgcaattcaacttctacttgggtgacctatgggacctgtaaccaggctggcgagcataggagggataagaggtccgtcgccctggctcctcacgttggtatgggcctggacaccagaacccagacatggatgagcgctgagggagcttggaagcacgcccagaggatcgagacctggattctgcgccatccaggctttatcatcatggctgccatcctggcttatacaattgggaccactcacttccagagagccctcatcttcattctgctcaccgccgcggcaccatctatgaccatgaggtgcatcggcatcagcaacagggacttcgtggagggcgtgagcggcgccacctgggtggacgtggtgctggagcacggcggctgcgtgaccaccatggccaagaacaagcccaccctggacatcgagctgctgaagaccgaggtgaccaaccccgccgtgctgaggaagctgtgcatcgaggccagcatcagcaacaccaccaccgacagcaggtgccccacccagggcgaggccaccctggtggaggagcaggacaccaacttcgtgtgcaggaggaccttcgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgaggccaccgccaggggcgccaggaggatggccatcctcggcgatacagcctgggattttggctcaatcggaggggtgttcaccagcatcggcaaggccctgcaccaggttttcggcagcgtgtacaccacaatgtttggcggcgtctcttggatggtgagaatcctgatcgggttcctcgtcctgtggattggaaccaatagcaggagcacaagcctgagcatgacctgcatcgctgttggcatggtcacactctacctgggtgtgatggttcaggca

SEQ ID NO: 256 - DNA, 2025 bp, Artificial Sequence
  Synthetic polynucleotide: 18H6-D4 (18H6 extended to C15/full length prM/full length E with WT Den-4 E protein residues)
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccagtccggagagagaaggagggagaagaggtccgtcgccctgactcctcactctggtatgggcctggaaaccagagccgagacatggatgagctctgagggagcttggaagcacgcccagagggttgaatcttggattctgcgcaatccacgctttgcactcctggctggcttcatggcttatatgattgggcagactggtattcagaggaccgtcttcttcgttctgatgatgctcgtggcaccatcttacggcatgaggtgcgtgggcgtgggcaacagggacttcgtggagggcgtgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaacgcccacgccaagaggcaggacgtgaccgtgctgggcagccaggagggcgccatgcacagcgccctggccggcgccaccgagatccagatgagcagcggcaacctgctgttcaccggccacctgaagtgcaggctgaagatggacaagctgcagctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcaccgaggacggccagggcaaggcccacaacggcaggctgatcaccgtgaaccccatcgtgatcgacaaggagaagcccgtgaacatcgagctggagccccccttcggcgagagctacatcgtggtgggcgccggcgagaaggccctgaagctgagctggttcaagaagggcagcagcatcggcaagatgttcgaggccaccgccaggggcgccaagaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 257 - DNA, 2025 bp, Artificial Sequence
  Synthetic polynucleotide: 18H6-25B10ext (18H6 extended to C15/full length prM/full length E with 25B10 residues of E protein)
atgagatctgtgaccatgattctcatgctgctgcctactactctggccttccatctgacatcaagagatggcgagcctaggatgatcgtggccaagcacgaaagagggaggcctctgctgttcaagactactgaagggatcaataagtgcactctcatcgccatggacctgggcgagatgtgtgacgataccgtgacctacaagtgtccacacatcaccgaggtcgaacccgaggatatcgattgctggtgcaattcaacttctacttgggtgacctatgggacctgtaaccaggctggcgagcataggagggataagaggtccgtcgccctggctcctcacgttggtatgggcctggacaccagaacccagacatggatgagcgctgagggagcttggaagcacgcccagaggatcgagacctggattctgcgccatccaggctttatcatcatggctgccatcctggcttatacaattgggaccactcacttccagagagccctcatcttcattctgctcaccgccgcggcaccatctatgaccatgaggtgcatcggcatcagcaacagggacttcgtggagggcgtgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaacgcccacgccaagaggcaggacgtgaccgtgctgggcagccaggagggcgccatgcacagcgccctggccggcgccaccgagatccagatgagcagcggcaacctgctgttcaccggccacctgaagtgcaggctgaagatggacaagctgcagctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcaccgaggacggccagggcaaggcccacaacggcaggctgatcaccgtgaaccccatcgtgatcgacaaggagaagcccgtgaacatcgagctggagccccccttcggcgagagctacatcgtggtgggcgccggcgagaaggccctgaagctgagctggttcaagaagggcagcagcatcggcaagatgttcgaggccaccgccaggggcgccaagaggatggccatcctcggcgatacagcctgggattttggctcaatcggaggggtgttcaccagcatcggcaaggccctgcaccaggttttcggcagcgtgtacaccacaatgtttggcggcgtctcttggatggtgagaatcctgatcgggttcctcgtcctgtggattggaaccaatagcaggagcacaagcctgagcatgacctgcatcgctgttggcatggtcacactctacctgggtgtgatggttcaggca

SEQ ID NO: 258 - DNA, 2025 bp, Artificial Sequence
  Synthetic polynucleotide: 25B6 (C15/full length prM/ full length E)
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagctgtgtgaggataccatcacctacaagtgtccactgctgaggcaggacgaacccgaggatatcgattgctggtgcaatgcaactgatacttgggtgacctatgggacctgtaaccaggctggcgagcataggagggataagaggtccgtcgccctgactcctcactctggtatgggcctggaaaccagagccgagacatggatgagctctgagggagcttggaagcagatccagaaggttgagacttgggctctgcgccatccaggctttacagtcattgccctgttcctggctcatgcaattgggacctctattactcagaagggcatcatcttcattctgctcatgctcgtgacaccatctatggccatgaggtgcgtgggcgtgggcaacagggacttcgtggagggcctgagcggcgccacctgggtggacgtggtgctggagcacggcggctgcgtgaccaccatggccaagaacaagcccaccctggacatcgagctgcagaagaccgaggccacccagctggccaccctgaggaagctgtgcatcgagggcaagatcaccaacatcaccaccgacagcaggtgccccacccagggcgaggccatcctgcccgaggagcaggaccagcagtacatctgcaggagggacgtggtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaagcagtggttcctggacctgcccctgccctggaccagcggcgccagcaccagccaggagacctggaacaggcaggacctgctggtgaccttcaagaccgcccacgccaagaagcaggaggtggtggtgctgggcagccaggagggcgccatgcacaccgccctgaccggcgccaccgagatccagatgagcagcggcaacctgctgttcaccggccacctgaagtgcaggctgaagatggacaagctggagctgaagggcatgagctacgccatgtgcctgaacaccttcgtgctgaagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccatcgtgatcgacaaggagaagcccgtgaacatcgaggccgagccccccttcggcgagagctacatcgtgatcggcatcggcgacaaggccctgaagatcaactggtacaagaagggcagcagcatcggcaagatgttcgaggccaccgccaggggcgccaggaggatggccatcctcggcgatacagcctgggattttggctcaatcggaggggtgttcaccagcgtgggtaaactgattcatcagattttcggtacagcatatggcgtgctgttttccggcgtctcttggaccatgaagatcggtattggcatcctcctcacatggctgggactgaatagcaggagcacaagcatgagctttagctgcatcgctattggcatcatcacactctacctgggtgtggtggttcaggca

SEQ ID NO: 259 - DNA, 2025 bp, Artificial Sequence
  Synthetic polynucleotide: 25B10 (C15/full length prM/ full length E)
atgagatctgtgaccatgattctcatgctgctgcctactactctggccttccatctgacatcaagagatggcgagcctaggatgatcgtggccaagcacgaaagagggaggcctctgctgttcaagactactgaagggatcaataagtgcactctcatcgccatggacctgggcgagatgtgtgacgataccgtgacctacaagtgtccacacatcaccgaggtcgaacccgaggatatcgattgctggtgcaattcaacttctacttgggtgacctatgggacctgtaaccaggctggcgagcataggagggataagaggtccgtcgccctggctcctcacgttggtatgggcctggacaccagaacccagacatggatgagcgctgagggagcttggaagcacgcccagaggatcgagacctggattctgcgccatccaggctttatcatcatggctgccatcctggcttatacaattgggaccactcacttccagagagccctcatcttcattctgctcaccgccgcggcaccatctatgaccatgaggtgcatcggcatcagcaacagggacttcgtggagggcgtgagcggcggcagctgggtggacatcgtgctggagcacggcagctgcgtgaccaccatggccaagaacaagcccaccctggacatcgagctgctgaagaccgaggtgaccaaccccgccgtgctgaggaagctgtgcatcgaggccaagatcagcaacaccaccaccgacagcaggtgccccacccagggcgaggccaccctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaccgcccacgccaagaagcaggaggtggtggtgctgggcagccaggagggcgccatgcacagcgccctggccggcgccaccgaggtccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtggagtacaagggcgaggacgccccctgcaagatccccttcagcaccgaggacggccagggcaaggcccacaacggcaggctgatcaccgccaaccccgtggtgaccaagaaggaggagcccgtgaacatcgaggccgagccccccttcggcaagagcaacatcgtgatcggcatcggcgacaaggccctgaagatcaactggtacaagaagggcagcagcatcggcaagatgttcgaggccaccgccaggggcgccaggaggatggccatcctcggcgatacagcctgggattttggctcaatcggaggggtgttcaccagcatcggcaaggccctgcaccaggttttcggcagcgtgtacaccacaatgtttggcggcgtctcttggatggtgagaatcctgatcgggttcctcgtcctgtggattggaaccaatagcaggagcacaagcctgagcatgacctgcatcgctgttggcatggtcacactctacctgggtgtgatggttcaggca

SEQ ID NO: 260 - DNA, 2031 bp, Artificial Sequence
  Synthetic polynucleotide: 25D4 (C15/full length prM/full length E)
atgagatctgtgaccatgattctcatgctgctgcctactgctctggccttccatctgacaacaagaggtggcgagcctaccctgatcgtgtccaagcaagaacgcggcaagagcctgctgttcaagacttctgcagggatcaatatgtgcactctcatcgccatggacctgggcgagatgtgtgacgataccgtgacctacaagtgtccacacatcaccgaggtcgaacccgaggatatcgattgctggtgcaatctgacttctacttgggtgacctatgggacctgtaaccaggctggcgagcataggagggataagaggtccgtcgccctggttcctcacgttggtatgggcctggaaaccagaaccgagacatggatgagctctgagggagcttggaagcacgcccagaggatcgagacctggattctgcgccatccaggctttacaatcctggccctgttcctggctcattacattgggacctctctgactcagaaggtcgtcatcttcattctgctcatgctcgtgacaccatctatgaccatgaggtgcatcggcatcagcaacagggacttcgtggagggcctgagcggcgccacctgggtggacgtggtgctggagcacggcagctgcgtgaccaccatggccaagaacaagcccaccctggacttcgagctgatcaagaccgaggccacccagcccgccaccctgaggaagtactgcatcgaggccaagctgaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtggtggtgaccgtgcacaacggcgacacccacgccgtgggcaacgacaccagcaaccacggcgtgaccgccaccatcacccccaggagccccagcgtggaggtgaagctgcccgactacggcgagctgaccctggactgcgagcccaggagcggcatcgacttcaacgagatgatcctgatgaagatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacaccgccctgaccggcgccaccgagatccagatgagcagcggcaaccacatgttcgccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgccaaccccgtggtgaccaagaaggacagccccgtgaacatcgaggccgagccccccttcggcgacagctacatcatcatcggcgtggagcccggccagctgaagctgcactggttcaagaagggcagcagcatcggccagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcaggca

SEQ ID NO: 261 - DNA, 2025 bp, Artificial Sequence
  Synthetic polynucleotide: 25E11 (C15/full length prM/full length E)
atgaaaactagcctctgcctgatgatgatgctgcctgctactctggccttccatctgacatcaagagatggcgagcctaggatgatcgtgggcaagaacgaaagagggaagagcctgctgttcaagactgcttcagggatcaatatgtgcactctcatcgccatggacctgggcgagatgtgtgacgataccgtgacctacaagtgtccacacatcaccgaagtcgaacccgaggatatcgattgctggtgcaatctgacttctacttgggtgacctatgggacctgtacccagtccggagagagaaggagggagaagaggtccgtcgccctgactcctcactctggtatgggcctggaaaccagaaccgagacatggatgagctctgagggagcttggaagcagatccagaaggttgagacttgggctctgcgccatccaggctttacagtcattgccctgttcctggctcatgcaattgggacctctattactcagaagggcatcatcttcattctgctcatgctcgtgacaccatctatggccatgaggtgcgtgggcgtgggcaacagggacttcgtggagggcctgagcggcgccacctgggtggacatcgtgctggagcacggctcctgcgtgaccaccatggccaagaacaagcccaccctggacttcgagctgatcaagaccgaggccacccagcccgccaccctgaggaagctgtgcatcgagggcaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcgccctgaccctggactgcagccccaggaccggcctggacttcaacagggtggtgctgctgaccatgaagaagaagagctggctggtgcacaagcagtggttcctggacctgcccctgccctggaccagcggcgccagcaccagccaggagacctggaacaggcaggacctgctggtgaccttcaagaccgcccacgccaagaagcaggaggtggtggtgctgggcagccaggagggcgccatgcacaccgccctgaccggcaccaccgagatccagaacagcggcggcaccagcatcttcgccggccacctgaagtgcaggctgaagatggacaagctgaccctgaagggcgtgagctacgtgatgtgcaccggcagcttcaagctggagaaggaggtgagcgagacccagcacggcaccatcctgatcaaggtggagtacaagggcgaggacgccccctgcaaggtgcccatcgagatcagggacgtgaacaaggagaaggtggtgggcaggatcatcagcagcacccccctggccgagaacaccaacagcgtgaccaacatcgagctggagccccccttcggcgacagctacatcgtgatcggcgtgggcgacagcgccctgaccctgcactggttcaggaagggcagcagcatcggcaagatgttcgaggccaccgccaggggcgccaggaggatggccatcctcggcgatacagcctgggattttggctcaatcggaggggtgttcaccagcgtgggtaaactgattcatcagattttcggtacagcatatggcgtgctgttttccggcgtctcttggaccatgaagatcggtattggcatcctcctcacatggctgggactgaatagcaggagcacaagcctgagcatgacctgcatcgctgttggcatggtcacactctacctgggtgtgatggttcaggca

SEQ ID NO: 262 - DNA, 2025 bp, Artificial Sequence
  Synthetic polynucleotide: 25H4 (C15/full length prM/full length E)
atgagatctgtgaccatgattctcatgctgctgcctactgctctggccttccatctgacaacaagaggtggcgagcctctcatgatcgtggccaagcacgaaagagggaagagcctgctgttcaagactgcttcagggatcaatatgtgcactctcatcgccatggacctgggcgagatgtgtgacgataccgtgacctacaagtgtccacggatgaccgaggtcgaacccgaggatatcgattgctggtgcaatctgacttctacttgggtgacctatgggacctgtaccaccacaggcgagcataggagggagaagaggtccgtcgccctggttcctcacgttggtatgggcctggaaaccagaaccgagacatggatgagctctgagggagcttggaagcagatccagaaggttgagacttgggctctgcgccatccaggctttacaatcctggccctgttcctggctcattacattgggacctctctgactcaggaggtcgtcatcttcattctgctcatgctcgtgacaccatctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccaagatcagcaacaccaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcgtgaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaagcagtggttcctggacctgcccctgccctggaccagcggcgccagcaccagccaggagacctggaacaggcaggacctgctggtgaccttcaagaccgcccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacttcggcagcctgggcggcgtgttcaccagcatcggcaaggccctgcaccaggttttcggtgcaatctatggcgcagccttttccggcgtctcttggaccatgaagatcctgatcggggtcatcatcacatggattggaatgaatagcaggagcacaagcctgagcgttagcctcgtcctggttggcgtcatcacactctacctgggtgccatggttcaggca

SEQ ID NO: 263 - DNA, 2025 bp, Artificial Sequence
  Synthetic polynucleotide: 27A11 (C15/full length prM/full length E)
atgaaaactagcctctgcctgatgatgatgctgcctactgctctggccttccatctgacaacaagaggtggcgagcctaccctgatcgtgtccaagcaagaacgcggcaagagcctgctgttcaagacttctgcaggggtgaatatgtgcactctcatcgccatggacctgggcgagctgtgtgaggataccatgacctacaagtgtccacggatgaccgaggccgaacccgacgatgtggattgctggtgcaatgcaactgatacttgggtgacctatgggacctgtagccagacaggcgagcataggagggagaagaggtccgtcgccctggttcctcacgttggtatgggcctggaaaccagaaccgagacatggatgagctctgagggagcttggaagcagatccagaaggttgagacttgggctctgcgccatccaggctttacagtcattgccctgttcctggctcatgcaattgggacctctattactcagaagggcatcatcttcattctgctcatgctcgtgacaccatctatggccatgaggtgcgtgggcatcggcaaccgcgacttcgtggagggcgtgagcggcggcagctgggtggacatcgtgctggagcacggctcctgcgtgaccaccatggccaagaacaagcccaccctggacatcgagctgctgaagaccgaggtgaccaaccccgccgtgctgaggaagctgtgcatcgaggccaagatcagcaacaccaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgactacggcgagctgaccctggactgcgagcccaggagcggcatcgacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacaccgccctgaccggcaccaccgagatccagaacagcggcggcaccagcatcttcgccggccacctgaagtgcaaggtgaggatggagaagctgcgcatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagggacgtgaacaaggagaaggtggtgggcaggatcatcagcagcacccccctggccgagaacaccaacagcgtgaccaacatcgagctggagccccccttcggcgacagctacatcgtgatcggcgtgggcgacagcgccctgaccctgcactggttcaggaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 264 - DNA, 2031 bp, Artificial Sequence
  Synthetic polynucleotide: 27G6 (C15/full length prM/full length E)
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaattcaacttctacttgggtgatgtatgggacctgtagccagacaggcgagcataggagggataagaggtccgtcgccctggttcctcacgttggtatgggcctggaaaccagaaccgagacatggatgagctctgagggagcttggaagcagatccagaaggttgagacttgggctctgcgccatccaggctttacagtcattgccctgttcctggctcattacattgggacctctctgactcagaaggtcgtcatcttcattctgctcatgctcgtgacaccatctatgaccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccaagatcagcaacaccaccaccgacagcaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaagatcgtgcagtacgagaacctggagtacaccatcgtgatcaccccccacagcggcgaggagcacgccgtgggcaacgacaccagcaaccacggcgtgaccgccaccatcacccccaggagccccagcgtggaggtgaagctgcccggctacggcaccgtgaccatggagtgcagccccaggaccggcctggacttcaacagggtggtgctgctgaccatgaagaagaagagctggctggtgcacaagcagtggttcctggacctgcccctgccctggaccagcggcgccaccaccgagacccccacctggaacaggaaggagctgctggtgaccttcaagaacgcccacgccaagaggcaggacgtgaccgtgctgggcagccaggagggcgccatgcacagcgccctggccggcgccaccgaggtggacagcggcgacggcaaccacatgttcgccggccacctgaagtgcaaggtgaggatggagaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccgtggtgaccaagaaggaggagcccgtgaacatcgaggccgagccccccttcggcgagagcaacatcgtgatcggcgtgggcgacagcgccctgaccctgcactggttcaggaagggcagcagcatcggcaagatgttcgagagcacctacaggggcgccaggaggatggccatcctgggcgacaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 265 - DNA, 2025 bp, Artificial Sequence
  Synthetic polynucleotide: 28A11 (C15/full length prM/ full length E)
atgagatctaccatcaccctgctctgcctgatccctactgttatggccttccatctgacaacaagaaatggcgagcctaggatgatcgtgggcaagaacgaaagagggaagagcctgctgttcaagactgaggacggcgtgaatatgtgcactctcatggccatcgacctgggcgagctgtgtgaggataccatcacctacaagtgtccactgctggtcaacaccgaacccgaggatatcgattgctggtgcaatctgacttctacttgggtgacctatgggacctgtaaccaggctggcgagcataggagggataagaggtccgtcgccctggctcctcacgttggtatgggcctggaaaccagaaccgagacatggatgagctctgagggagcttggaagcagatccagaaggttgagacttgggctctgcgccatccaggctttacaatcctggccctgttcctggctcatgcaattgggacctctattactcagaagggcatcatcttcattctgctcatgctcgtgacaccatctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccaagatcaccaacatcaccaccgacagcaggtgccccacccagggcgaggccatcctgcccgaggagcaggaccagaactacgtgtgcaagcacagcatggtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgatgaagatgaagaagaagacctggctggtgcacaggcagtggttcctggacctgcccctgccctggaccagcggcgccagcaccagccaggagacctggaacaggcaggacctgctggtgaccttcaagaacgcccacgccaagaagcaggaggtggtggtgctgggcagccaggagggcgccatgcacaccgccctgaccggcgccaccgagatccagaccagcggcaccaccaccatcttcgccggccacctgaagtgcaaggtgaggatggagaagctgcgcatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagggacgtgaacaaggagaaggtggtgggcaggatcatcagcagcacccccctggccgagaacaccaacagcgtgaccaacatcgagctggagccccccttcggcgacagctacatcgtgatcggcgtgggcgacagcgccctgaccctgcactggttcaggaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctattggcatcatcacactctacctgggtgtggtggttcaggca

SEQ ID NO: 266 - DNA, 2031 bp, Artificial Sequence
  Synthetic polynucleotide: 28C1 (C15/full length prM/full length E)
atgaaaactagcctctgcctgatgatgatgctgcctgctactatggccttctctctgtcaacaagagatggcgagcctctcatgatcgtggccaagcacgaaagagggaggcctctgctgttcaagactactgaagggatcaataagtgcactctcatcgccatggacctgggcgagctgtgtgaggataccatgacctacaagtgtccactgctgaggcagaacgaacccgaggatatcgattgctggtgcaattcaacttctacttgggtgacctatgggacctgtaaccaggctggcgagcataggagggataagaggtccgtcgccctggaccctcacgttggtctgggcctggaaaccagaacccagacatggatgagcgctgagggagcttggaggcaggtcgagaaggttgaaacttgggctctgcgccatccaggctttacagtcattgccctgttcctggctcatgcaattgggacctctattactcagaagggcatcatcttcattctgctcatgctcgtgacaccatctatggccatgaggtgcgtgggcatcggcaaccgcgacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccaggagccccagcgtggaggtgaagctgcccgactacggcgagctgaccctggactgcgagcccaggagcggcatcgacttcaacgagatgatcctgatgaagatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaaggtgaggatgtagaagctgcgcatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagggacgtgaacaaggagaaggtggtgggcaggatcatcagcagcacccccctggccgagaacaccaacagcgtgaccaacatcgagctggagccccccttcggcgacagctacatcgtgatcggcatcggcgacaaggccctgaagatcaactggttcaggaagggcagcagcatcggcaagatgttcgaggccaccgccaggggcgccaggaggatggccatcctgggcgacaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 267 - DNA, 2025 bp, Artificial Sequence
  Synthetic polynucleotide: 28D11 (C15/full length prM/full length E)
atgagatctaccatcaccctgctctgcctgatccctactgttatggccttctctctgtcaacaagagatggcgagcctctcatgatcgtgggcaagaacgaaagagggaagagcctgctgttcaagactgcttcagggatcaatatgtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccaggctggcgagcataggagggataagaggtccgtcgccctggctcctcacgttggtatgggcctggacaccagaacccagacatggatgagctctgagggagcttggaagcagatccagaaggttgagacttgggctctgcgccatccaggctttacagtcattgccctgttcctggctcatgcaattgggacctctattactcagaagggcatcatcttcattctgctcatgctcgtgacaccatctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgcagaagaccgaggccacccagctggccaccctgaggaagctgtgcatcgagggcaagatcagcaacaccaccaccgacagcaggtgccccacccagggcgaggccaccctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacaccgccctgaccggcgccaccgagatccagaccagcggcaccaccaccatcttcgccggccacctgaagtgcaggctgaagatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccgtggtgaccaagaaggaggagcccgtgaacatcgaggccgagccccccttcggcgagagcaacatcgtgatcggcatcggcgacagcgccctgaccctgcactggttcaggaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcgtcatcacactctacctgggtgccatggttcaggca

SEQ ID NO: 268 - DNA, 2025 bp, Artificial Sequence
  Synthetic polynucleotide: 28E12( C15/full length prM/full length E)
atgaaaactagcctctgcctgatgatgatgctgcctgctactctggccttccatctgacatcaagagatggcgagcctaggatgatcgtgggcaagaacgaaagagggaagagcctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgacctatgggacctgtaccaccacaggcgagcataggagggagaagaggtccgtcgccctggaccctcacgttggtctgggcctggaaaccagaaccgagacatggatgagctctgagggagcttggaggcaggtcgagaaggttgaaacttgggctctgcgccatccaggctttacaatcctggccctgttcctggctcattacattgggacctctctgactcagaaggtcgtcatcttcattctgctcatgctcgtgacaccatctatgaccatgaggtgcgtgggcgcgggcaacagggacttcgtggagggcctgagcggcgccacctgggtggacgtggtgctggagcacggcagctgcgtgaccaccatggccaagaacaagcccaccctggacttcgagctgatcaagaccgaggccacccagcccgccaccctgaggaagtactgcatcgaggccaagatcaccaacatcaccaccgacagcaggtgccccacccagggcgaggccatcctgaacgaggagcaggacaagaggttcgtgtgcaagcacagcatggtggacaggggctggggcaacggctgcggcctgttcggcaagggcggcgtggtgacctgcgccatgttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgcggggcagccaggagggcgccatgcacagcgccctggccggcgccaccgaggtggacagcggcgacggcaaccacatgttcgccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtgggcgacagcgccctgaccctgcactggttcaggaagggcagcagcatcggcaagatgttcgagagcacctacaggggcgccaggaggatggccatcctcggcgatacagcctgggattttggctcaatcggaggggtgttcaccagcgtgggtaaactgattcatcagattttcggtacagcatatggcgtgctgttttccggcgtctcttggaccatgaagatcggtattggcatcctcctcacatggctgggaatgaatagcaggagcacaagcctgagcgttagcctcgtcctggttggcgtcatcacactctacctgggtgccatggttcaggca

SEQ ID NO: 269 - DNA, 2043 bp, Artificial Sequence
  Synthetic polynucleotide: 28F9 (C15/full length prM/full length E)
atgaacaggaggaggagaactgtgggcgtgattatcatgctgatccctactgctatggccttccatctgacaacaagaaatggcgagcctcggatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgacctatgggacctgtagccagacaggcgagcataggagggagaagaggtccgtcgccctggaccctcacgttggtctgggcctggaaaccagaaccgagacatggatgaactctgagggagcttggaagcagatccagaaggttgagacttgggctctgcgccatccaggctttacagtcattgccctgttcctggctcatgcaattgggacctctattactcagaagggcatcatcttcattctgctcatgctcgtggcaccatcttacggcatgaggtgcgtgggcgtgggcaacagggacttcgtggagggcgtgagcggcggcgcctgggtggacctggtgctggagcacggcggctgcgtgaccaccatggccaagaacaagcccaccctggacttcgagctgatcaagaccgaggccacccagcccgccaccctgaggaagtactgcatcgaggccaagctgaccaataccaccaccgacagcaggtgccccacccagggcgagcccagcctgaaggaggagcaggaccagcagtacatctgcaggagggacgtggtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacaccagcaaccacggcgtgaccgccaccatcacccccaggagccccagcgtggaggtgaagctgcccgactacggcgagctgaccctggactgcgagcccaggagcggcatcgacttcaacgagatgatcctgatgaagatgaagaagaagacctggctggtgcacaagcagtggttcctggacctgcccctgccctggaccgccggcgccgacaccagcgaggtgcactggaaccacaaggagaggatggtgaccttcaaggtaccccacgccaagaggcaggacgtgaccgtgctgggcagccaggagggcgccatgcacagcgccctggccggcgccaccgaggtggacagcggcgacggcaaccacatgttcgccggccacctgaagtgcaaggtgaggatggagaagctgcgcatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagggacgtgaacaaggagaaggtggtgggcaggatcatcagcagcacccccctggccgagaacaccaacagcgtgaccaacatcgagctggagccccccttcggcgacagctacatcgtgatcggcgtgggcgacagcgccctgaccctgcactggttcaagaagggcagcagcatcggcaagatgttcgaggccaccgccaggggcgccaggaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 270 - DNA, 2034 bp, Artificial Sequence
  Synthetic polynucleotide: 28H3 (C15/full length prM/full length E)
atgagacctaccatcaccctgctctgcctgatgatgatgctgcctgctactctggccttccatctgacaacaagaaatggcgagcctcacatgatcgtgggcaggcaagagaagggcaagagcctgctgttcaagactgaggacggcgtgaatatgtgcactctcatggccatcgacctgggcgagctgtgtgaggataccatcacctacaagtgtccactgctgaggcagaacgaacccgaggatatcgattgctggtgcaattcaacttctacttgggtgacctatgggacctgtaccaccacaggcgagcataggagggagaagaggtccgtcgccctggttcctcacgttggtatgggcctggaaaccagaaccgagacatggatgagctctgagggagcttggaagcacgcccagagggttgaatcttggattctgcgcaatccacgctttgcactcctggctggcttcatggcttatatgattgggcagactggtattcagaggaccgtcttcttcgttctgatgatgctcgtggcaccatcttacggcatgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagtactgcatcgaggccaagctgaccaataccaccaccgagagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacagggtggtgctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacaccatgtgcagcggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgatcgacaaggagaagcccgtgaacatcgaggccgagccccccttcggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacttcggcagcctgggcggcgtgttcaccagcatcggcaaggccctgcaccaggttttcggtgcaatctatggcgcagccttttccggcgtctcttggaccatgaagatcctgatcggggtcatcatcacatggattggaatgaatagcaggagcacaagcctgagcgttagcctcgtcctggttggcgtcatcacactctacctgggtgccatggttcaggca

SEQ ID NO: 271 - DNA, 2025 bp, Artificial Sequence
  Synthetic polynucleotide: 28H9 (C15/full length prM/full length E)
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccagtccggagagagaaggagggagaagaggtccgtcgccctggttcctcacgttggtatgggcctggaaaccagaaccgagacatggatgagcgctgagggagcttggaggcaggtcgagaaggttgaaacttgggctctgcgccatccaggctttacaatcctggccctgttcctggctcattacattgggacctctctgactcagaaggtcgtcatcttcattctgctcatgctcgtgacaccatctatgaccatgaggtgcgtgggcgtgggcaacagggacttcgtggagggcgtgagcggcggcagctgggtggacatcgtgctggagcacggctcctgcgtgaccaccatggccaagaacaagcccaccctggacttcgagctgatcaagaccgaggccacccagcccgccaccctgaggaagtactgcatcgaggccaagctgaccaataccaccaccgagagcaggtgccccacccagggcgagcccagcctgaacgaggagcaggacaagaggttcgtgtgcaagcacagcatggtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacaccgccctgaccggcaccaccgagatccagaacagcggcggcaccagcatcttcgccggccacctgaagtgcaggctgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcaggctgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgagagcacctacaggggcgccaagaggatggccatcctgggcgagaccgcctgggacttcggcagcgtgggcggcgtgctgaacagcctgggcaagatggtgcaccagatcttcggttcagcatataccgcactgttttccggcgtctcttggaccatgaagatcctgatcggggtcatcatcacatggattggaatgaatagcaggagcacaagcctgagcgttagcctcgtcctggttggcgtcatcacactctacctgggtgccatggttcaggca

SEQ ID NO: 272 - DNA, 48 bp, Artificial Sequence
  Synthetic polynucleotide: 6C6 PRM15 DNA
atgaccgtgttcttcatcctgatgatgctggtgaccccctctatggcc

SEQ ID NO: 273 - DNA, 48 bp, Artificial Sequence
  Synthetic polynucleotide: 6F4 PRM15 DNA
atggccgtgttcttcatcctgctgatgctggtgaccccctccatgaca

SEQ ID NO: 274 - DNA, 48 bp, Artificial Sequence
  Synthetic polynucleotide: 7A9 PRM15 DNA
atgaccgtgttcttcatcctgatgatgctggtggccccctcctacgcc

SEQ ID NO: 275 - DNA, 48 bp, Artificial Sequence
  Synthetic polynucleotide: 11E2 PRM15 DNA
atgaccgtgttcttcatcctgctgatgctggtggccccctcctacggc

SEQ ID NO: 276 - DNA, 48 bp, Artificial Sequence
  Synthetic polynucleotide: 12E3 PRM15 DNA
atggccgtgttcttcatcctgatgatgctggtggccccctcctacggc

SEQ ID NO: 277 - DNA, 48 bp, Artificial Sequence
  Synthetic polynucleotide: 15C2 PRM15 DNA
atggtggtgatcttcatcctgctgatgctggtgaccccctctatggcc

SEQ ID NO: 278 - DNA, 48 bp, Artificial Sequence
  Synthetic polynucleotide: 17A12 PRM15 DNA
atgaccgtgttcttcatcctgatgatgctggtgaccccctccatgaca

SEQ ID NO: 279 - DNA, 48 bp, Artificial Sequence
  Synthetic polynucleotide: 17D5 PRM15 DNA
atgaccgtgttcttcatcctgctgatgctggtgaccccctccatgaca

SEQ ID NO: 280 - DNA, 48 bp, Artificial Sequence
  Synthetic polynucleotide: 17G5 PRM15 DNA
atgaccgtgttcttcatcctgatgatgctggtggccccctctatggcc

SEQ ID NO: 281 - DNA, 48 bp, Artificial Sequence
  Synthetic polynucleotide: DEN-1 PRM15 of DEN-1 PRM15/tE CO parent
atgggcatcatcttcatcctgctgatgctggtgaccccctctatggcc

SEQ ID NO: 282 - DNA, 48 bp, Artificial Sequence
  Synthetic polynucleotide: DEN-2 PRM15 of DEN-2 PRM15/tE CO parent
atgggcctgatcctgatcctgcagaccgccgtggccccctccatgaca

SEQ ID NO: 283 - DNA, 48 bp, Artificial Sequence
  Synthetic polynucleotide: DEN-3 PRM15 of DEN-3 PRM15/tE CO parent
atggtggtgatcttcatcctgctgatgctggtgaccccctccatgaca

SEQ ID NO: 284 - DNA, 48 bp, Artificial Sequence
  Synthetic polynucleotide: DEN-4 PRM15 of DEN-4 PRM15/tE CO parent
atgaccgtgttcttcatcctgatgatgctggtggccccctcctacggc

SEQ ID NO: 285 - DNA, 1338 bp, Artificial Sequence
  Synthetic polynucleotide: 2/7-NPRM Round I shuffled clone no PRM
atgaggtgcatcggcatcagcaacagggacttcgtggagggcgtgagcggcgccacctgggtggacgtggtgctggagcacggcagctgcgtgaccaccatggccaagaacaagcccaccctggacatcgagctgatcaagaccgaggccacccagcccgccaccctgaggaagtactgcatcgaggccaagctgaccaataccaccaccgagagcaggtgccccacccagggcgagccctacctgaaggaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 286 - DNA, 1341 bp, Artificial Sequence
  Synthetic polynucleotide: 2G11-NPRM Round I shuffled clone no PRM
atgaggtgcgtgggcatcggcaaccgcgacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaacaaggcctggatggtgcacaggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacagcgccctggccggcgccaccgagatccagatgagcagcggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcgccggcgagaaggccctgaagctgagctggttcaagaagggcagcagcatcggccagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 287 - DNA, 1338 bp, Artificial Sequence
  Synthetic polynucleotide: 5/21-NPRM Round I shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgatcgacaaggagaagcccgtgaacatcgaggccgagccccccttcggcgagagctacatcgtggtcggcgtgggcgacagcgccctgaccctgcactggttcaggaagggcagcagcatcggccagatgttcgagaccaccatgaggggcgccaagaggatggccatcttgggcgacaccgcctgggacttcggcagcctgggcggcgtgttcaccagcatcggcaaggccctgcaccaggtgttcggcgccatctacggcgcc

SEQ ID NO: 288 - DNA, 1281 bp, Artificial Sequence
  Synthetic polynucleotide: 6C6-NPRM Round I shuffled clone no PRM
atgaggtgcgtgggcatcggcaaccgcgacttcgtggagggcgtgagcggcggcgcctgggtggacctggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcggcatcgtgacctgcgccatgttcacctgcaagaagaacatggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatgatcctgatgaagatgaagaacaaggcctggatggtgcacaggcagtggttcctggacctgcccctgccctggaccgccggcgccgacaccgagacccccacctggaacaggaaggagctgctggtgaccttcaagaacgcccacgccaagaagcaggaggtggtggtgctgggcagccaggagggcgccatgcacagcgccctggccggcgccaccgaggtggacagcggcgacggcaaccacatgttcgccggccacctgaagtgcaaggtgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcactgtgaaccccatcgtgaccgagaaggacagccccgtgaacatcgaggccgagccccccttcggcgacagctacatcatcatcggcgtggagcccggccagctgaagctgcactggttcaagaagggcagcagcatcggcaagatgttcgaggccaccgccaggggcgccaggaggatggccatcctgggcgacaccgcctgggacttcggcagcgcctacacc

SEQ ID NO: 289 - DNA, 1344 bp, Artificial Sequence
  Synthetic polynucleotide: 6E12-NPRM Round I shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaccaccaccatcttcgccggccacctgaagtgcaaggtgaggatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcagccaggacgagaagggcgtgacccagaacggcaggctgatcaccgccaaccccatcgtgatcgacaaggagaagcccgtgaacatcgaggccgagcccccctttggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacttcggcagcgtgggcggcctgctgaccagcctgggcaagatggtgcaccagatcttcggcagcgtgtacaccaccatgttcggc

SEQ ID NO: 290 - DNA, 1332 bp, Artificial Sequence
  Synthetic polynucleotide: 6F4-NPRM Round I shuffled clone no PRM
atgaggtgcgtgggcatcggcaaccgcgacttcgtggagggcgtgagcggcggcgcctgggtggacctggtgctggagcacggcggctgcgtgaccaccatggccaagaacaagcccaccctggacttcgagctgatcaagaccgaggccacccagcccgccaccctgaggaagtactgcatcgaggccaagctgaccaataccaccaccgagagcaggtgccccacccagggcgaggccatcctgcccgaggagcaggaccagcagtacatctgcaggagggacgtggtggacaggggctggggcaacggctgcggcctgttcggcaagggcagcctgatcacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagagctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaaggtgaggatggagaagctgcgcatcaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtggagcccggccagctgaagctgcactggttcaagaagggcagcagcatcggccagatgttcgaggccaccgccaggggcgccaggaggatggccatcctgggcgacaccgcctgggacttcggcagcgtgggcggcgtgttcaccagcatcggcaaggccctgcaccaggtgttcggcgccatctacggcgcc

SEQ ID NO: 291 - DNA, 1344 bp, Artificial Sequence
  Synthetic polynucleotide: 7A9-NPRM Round I shuffled clone no PRM
atgaggtgcgtgggcatcggcaaccgcgacttcgtggagggcgtgagcggcgccacctgggtggacgtggtgctggagcacggcggctgcgtgaccaccatggccaagaacaagcccaccctggacatcgagctgcagaagaccgaggccacccagctggccaccctgaggaagctgtgcatcgaggccagcatcagcaacatcaccaccgccaccaggtgccccacccagggcgaggccaccctggtggaggagcaggacaccaacttcgtgtgcaggaggaccttcgtggacaggggctggggcaacggctgcggcctgttcggcaagggcagcctggtgacctgcgccaagttccagtgcctggagcccatcgagggcaaggtggtgcagcacgagaacctgaagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatgatcctgctgaccatgaagagcaagacctggctggtgcacaagcagtggttcctggacctgcccctgccctggaccgccggcgccgacaccagcgaggtgcactggaaccacaaggagaggatggtgaccttcaagaacgcccacgccaagaagcaggaggtggtggtgctgggcagccaggagggcgccatgcacaccgccctgaccggcaccaccgagatccagaacagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtggagcccggccagctgaagctgcactggttcaggaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 292 - DNA, 1338 bp, Artificial Sequence
  Synthetic polynucleotide: 11E2-NPRM Round II shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctactgaccatgaagaagaagacctggctggtgcacaagcagtggttcctggacctgcccctgccctggaccgccggcgccagcaccagccaggagacctggaacaggaaggagctgctggtgaccttcaagaacgcccacgccaagaggcaggacgtgaccgtgctgggcagccaggagggcgccatgcacagcgccctgaccggcgccaccgagatccagatgagcagcggcaacctgctgttcgccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccctggagatcatggacctggagaagaggcacgtgctgggcaggctgatcaccgtgaaccccatcgtgaccgagaaggacagccccgtgaacatcgaggccgagccccccttcggcgagagctacatcgtggtcggcgtgggcgacagcgccctgaccctgcactggttcaggaagggcagcagcatcggccagatgttcgaggccaccgccaggggcgccaagaggatggccatcctgggcgacaccgcctgggacttcggcagcgtgggcggcgtgttcaccagcatcggcaaggccctgcaccaggtgttcggcgccatctacggcgcc

SEQ ID NO: 293 - DNA, 1347 bp, Artificial Sequence
  Synthetic polynucleotide: 12E3-NPRM Round II shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacatcgagctgatcaagaccaccgccaaggaggtggccctgctgaggacctactgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacagggtggtgctgctgaccatgaagaagaagagctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgagagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 294 - DNA, 1347 bp, Artificial Sequence
  Synthetic polynucleotide: 13E2-NPRM Round II shuffled clone no PRM
atgaggtgcgtgggcatcggcaaccgcgacttcgtggagggcgtgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatgatcctgctgaccatgaagaagaagagctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacaccatgtgcaccggcaagttccagatcgtgaaggagatcgccgagacccagcacggcaccatcgtgatcagggtgcagtacgagggcaccgacgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcatcatcggcgtggagcccggccagctgaagctgcactggttcaagaagggcagcagcatcggcaagatgttcgaggccaccgccaggggcgccaagaggatggccatcctgggcgagaccgcctgggacttcggcagcgtgggcggcctgctgaccagcctgggcaagatggtgcaccagatcttcggcagcgtgtacaccaccatgttcggc

SEQ ID NO: 295 - DNA, 1275 bp, Artificial Sequence
  Synthetic polynucleotide: 14E9-NPRM Round II shuffled clone no PRM
atgaggtgcgtgggcatcggcaaccgcgacttcgtggagggcgtgagcggcggcgcctgggtggacctggtgctggagcacggcggctgcgtgaccaccatggccaagaacaagcccaccctggacatcgagctgatcaagaccgaggccacccagcccgccaccctgaggaagtactgcatcgaggccaagatcaccaacatcaccaccgacagcaggtgccccacccagggcgaggccatcctgcccgaggagcaggaccagcagtacatctgcaggagggacgtggtggacaggggctggggcaacggctgcggcctgttcggcaagggcagcgtggtgacctgcgccaagttccagtgcgtgaccaagctggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgatgaagatgaagaacaaggcctggatggtgcacaagcagtggttcctggacctgcccctgccctggaccagcggcgccagcaccagccaggagacctggaacaggaaggagctgctggtgaccttcaagaacgcccacgccaagaagcaggaggtggtggtgctgggcagccaggagggcgccatgcacagcgccctggccggcgccaccgagatccagatgagcagcggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgcctacacc

SEQ ID NO: 296 - DNA, 1338 bp, Artificial Sequence
  Synthetic polynucleotide: 13E11-NPRM Round II shuffled clone no PRM
atgaggtgcgtgggcgtgggcaacagggacttcgtggagggcgtgagcggcggcgcctgggtggacgtggtgctggagcacggcggctgcgtgaccaccatggccaagaacaagcccaccctggacatcgagctgatcaagaccgaggccacccagcccgccaccctgaggaagtactgcatcgaggccagcatcagcaacatcaccaccgacaccaggtgccccacccagggtgagccctacctgaaggaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcaccgtgaccatggagtgcagccccaggaccggcctggacttcaacgagatgatcctgctgaccatgaagagcaagacctggctagtgcacaagcagtggttcctggacctgcccctgccctggaccgccggcgccgacaccgagacccccacctggaacaggaaggagctgctggtgaccttcaagaacgcccacgccaagaagcaggaggtggtggtgctgggcagccaggagggcgccatgcacaccgccctggccggcgccaccgagatccagatgagcagcggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcgtgatcagggtgcagtacgagggcaccgacgccccctgcaagatccccttcagcaccgaggacggccagggcaaggcccacaacggcaggctgatcaccgccaaccccatcgtgatcgacaaggagaagcccgtgaacatcgagctggagccccccttcggcgagagctacatcgtggtgggcgccggcgagaaggccctgaccctgcactggttcaggaagggcagcagcatcggccagatgttcgagaccaccatgaggggcgccaagaggatggccatcttgggcgagaccgcctgggacttcggcagcgtgggcggcgtgttcaccagcatcggcaaggccctgcaccaggtgttcggcgccatctacggcgcc

SEQ ID NO: 297 - DNA, 1332 bp, Artificial Sequence
  Synthetic polynucleotide: 16E8-NPRM Round II shuffled clone no PRM
atgaggtgcgtgggcgtgggcaacagggacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaagcagtggttcctggacctgcccctgccctggaccagcggcgccaccaccgagacccccacctggaacaggaaggagctgctggtgaccttcaagaccgcccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcctgatcaaggtggagtacaagggcgaggacgccccctgcaagatccccttcagcaccgaggacggccagggcaaggcccacaacggcaggctgatcaccgccaaccccatcgtgatcgacaaggagaagcccgtgaacatcgaggccgagccccccttcggcgagagcaacatcgtgatcggcatcggcgacaaggccctgaagatcaactggtacaagaagggcagcagcatcggcaagatgttcgagaccaccatgaggggcgccaagaggatggccatcttgggcgacaccgcctgggacttcggcagcgtgggcggcgtgttcaccagcatcggcaaggccctgcaccaggtgttcggcgccatctacggcgcc

SEQ ID NO: 298 - DNA, 1341 bp, Artificial Sequence
  Synthetic polynucleotide: 16E10-NPRM Round II shuffled clone no PRM
atgaggtgcatcggcatcagcaacagggacttcgtggagggcgtgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaaaatcagcaacaccaccaccgacagcaggtgccccacccagggcgaggccaccctggtggaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcatcaccgtgcacaccggcgaccagcaccaggtgggcaacgacacccagggcgtgaccgtggagatcaccccccaggccagcaccgtggaggccatcctgcccgagtacggcgccctgggcctggagtgcagccccaggaccggcctggacttcaacgagatgatcctgctgaccatgaagaacaaggcctggatggtgcacgggcagtggttcttcgacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacagcgccctggccggcgccaccgagatccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgatcgacaaggagaagcccgtgaacatcgaggccgagccccccttcggcgagagctacatcgtggtcggcgtgggcgacagcgccctgaccctgcactggttcaggaagggcagcagcatcggccagatgttcgagaccaccatgaggggcgccaagaggatggccatcttgggcgacaccgcctgggacttcggcagcgtgggcggcgtgctgaacagcctgggcaagatggtgcaccagatcttcggcagcgtgtacaccaccatgttcggc

SEQ ID NO: 299 - DNA, 1341 bp, Artificial Sequence
  Synthetic polynucleotide: 18E9-NPRM Round II shuffled clone no PRM
atgaggtgcgtgggcgtgggcaacagggacttcgtggagggcctgagcggcgccacctgggtggacgtggtgctggagcacggcggctgcgtgaccaccatggccaagaacaagcccaccctggacttcgagctgatcaagaccgaggccacccagcccgccaccctgaggaagtactgcatcgaggccaagctgaccaataccaccaccgccaccaggtgccccacccagggcgagccctacctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacagcgtgatcgtgaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagagctggctggtgcacaagcagtggttcctggacctgcccctgccctggaccagcggcgccagcaccagccaggagacctggaacaggaaggagctgctggtgaccttcaagaacgcccacgccaagaggcaggacgtgaccgtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcagccaggacgagaagggcgtgacccagaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgacaccgcctgggacttcggcagcgtgggcggcgtgctgaacagcctgggcaagatggtgcaccagatcttcggcagcgtgtacaccaccatgttcggc

SEQ ID NO: 300 - DNA, 1347 bp, Artificial Sequence
  Synthetic polynucleotide: 18E10-NPRM Round II shuffled clone no PRM
atgaggtgcgtgggcgtgggcaacagggacttcgtggagggcctgagcggcgccacctgggtggacgtggtgctggagcacggcggctgcgtgaccaccatggccaagaacaagcccaccctggacatcgagctgcagaagaccgaggccacccagctggccaccctgaggaagtactgcatcgaggccaagctgaccaataccaccaccgagagcaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggccagatgttcgagaccaccatgaggggcgccaagaggatggccatcttgggcgacaccgcctgggacttcggcagcgtgggcggcctgctgaccagcctgggcaaggccgtgcaccaggtgttcggcagcgtgtacaccaccatgttcggc

SEQ ID NO: 301 - DNA, 1332 bp, Artificial Sequence
  Synthetic polynucleotide: 18E11-NPRM Round II shuffled clone no PRM
atgaggtgcgtgggcgtgggcaacagggacttcgtggagggcctgagcggcgccacctgggtggacgtggtgctggagcacggcggctgcgtgaccaccatggccaagaacaagcccaccctggacttcgagctgatcaagaccaccgtcaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcctgatcaaggtggagtacaagggcgaggacgccccctgcaagatccccttcagcaccgaggacgagaagggcaaggcccacaacggcaggctgatcaccgccaaccccatcgtgatcgacaaggagaagcccgtgaacatcgaggccgagccccccttcggcgagagctacatcgtggtgggcgccggcgacaaggccctgaagctgagctggttcaagaagggcagcagcatcggccagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 302 - DNA, 1332 bp, Artificial Sequence
  Synthetic polynucleotide: 11B1-NPRM Round II shuffled clone no PRM
atgaggtgcatcggcatcagcaacagggacttcgtggagggcgtgagcggcgccacctgggtggacgtggtgctggagcacggcagctgcgtgaccaccatggccaagaacaagcccaccctggacatcgagctgatcaagaccgaggccacccagcccgccaccctgaggaagtactgcatcgaggccaagctgaccaataccaccaccgccaccaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgatacccagggcgtgaccgtggagatcaccccccaggccagcaccgtggaggccatcctgcccgagtacggcaccctgggcctggagtgtagccccaggaccggcctggacttcaacgagatgatcctgctgaccatgaagaacaaggcctggatggtgcacaggcagtggttcttcgacctgcccctgccctggaccagcggcgccaccaccgagacccccacctggaaccacaaggagaggatggtgaccttcaaggtgccccacgccaagaggcaggacgtgaccgtgctgggcagccaggagggcgccatgcacaccgccctgaccggcgccaccgaggtggacagcggcgacggcaaccacatgttcgccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgccaaccccatcgtgaccgagaaggacagccccgtgaacatcgaggccgagccccccttcggcgacagctacatcatcatcggcgtggagcccggccagctgaagctgcactggttcaggaagggcagcagcatcggccagatgttcgagagcacctacaggggcgccaagaggatggccatcctgggcgagaccgcctgggacttcggcagcgtgggcggcctgctgaccagcctgggcaaggccgtgcaccaggtgttcggcgccatctacggcgcc

SEQ ID NO: 303 - DNA, 1341 bp, Artificial Sequence
  Synthetic polynucleotide: 11B8-NPRM Round II shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagctgaccaataccaccaccgagagcaggtgccccacccagggcgagccctacctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacagggtggtgctgctgaccatgaagaagaagacctggctggtgcacaagcagtggttcctggacctgcccctgccctggaccgccggcgccgacaccgagacccccacctggaacaggaaggagctgctggtgaccttcaagaacgcccacgccaagaagcaggaggtggtggtgctgggcagccaggagggcgccatgcacagcgccctggccggcgccaccgagatccagatgagcagcggcaaccacatgttcgccggccacctgaagtgcaaggtgaggatggagaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggccagatgttcgaggccaccgccaggggcgccaggaggatggccatcctgggcgacaccgcctgggacttcggcagcgtgggcggcctgctgaccagcctgggcaagatggtgcaccagatcttcggcagcgtgtacaccaccatgttcggc

SEQ ID NO: 304 - DNA, 1281 bp, Artificial Sequence
  Synthetic polynucleotide: 11C4-NPRM Round II shuffled clone no PRM
atgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggacctactgcatcgaggccagcatcagcaacatcaccaccgagagcaggtgccccacccagggcgagccctacctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacgagatgatcctgctgaccatgaagagcaagacctggctggtgcacaagcagtggttcctggacctgcccctgccctggaccgccggcgccgacaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcagcccctgcaagatccccctggagatcatggacctggagaagaggcacgtgctgggcaggctgatcaccgtgaaccccatcgtgaccgagaaggacagccccgtgaacatcgaggccgagccccccttcggcgacagctacatcatcatcggcgtgggcgacaaggccctgaagctgcactggttcaagaagggcagcagcatcggcaagatgttcgaggccaccgccaggggcgccaagaggatggccatcctgggcgagaccgcctgggacttcggcagcgcctacacc

SEQ ID NO: 305 - DNA, 1332 bp, Artificial Sequence
  Synthetic polynucleotide: 11C11-NPRM Round II shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgagagcaggtgccccacccagggcgagccctacctgaaggaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagacctggctggtgcacaagcagtggttcctggacctgcccctgccctggaccgccggcgccgacaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgaggacgccccctgcaagatccccttcagcaccgaggacggccagggcaaggcccacaacggcaggctgatcaccgccaaccccatcgtgaccgagaaggacagccccgtgaacatcgaggccgagccccccttcggcgacagctacatcgtggtgggcgccggcgagaaggccctgaagctgcactggttcaagaagggcagcagcatcggccagatgttcgaggccaccgccaggggcgccaggaggatggccatcctgggcgacaccgcctgggacttcggcagcgtgggcggcgtgttcaccagcatcggcaaggccctgcaccaggtgttcggcgccatctacggcgcc

SEQ ID NO: 306 - DNA, 1275 bp, Artificial Sequence
  Synthetic polynucleotide: 12H4-NPRM Round II shuffled clone no PRM
atgaggtgcatcggcatcagcaacagggacttcgtggagggcgtgagcggcgccacctgggtggacgtggtgctggagcacggcagctgcgtgaccaccatggccaagaacaagcccaccctggacatcgagctgatcaagaccgaggccacccagcccgccaccctgaggaagtactgcatcgaggccagcatcagcaacatcaccaccgacagcaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagagctggctggtgcacaagcagtggttcctggacctgcccctgccctggaccgccggcgccgacaccgagacccccacctggaacaggaaggagctgctggtgaccttcaagaacgcccacgccaagaagcaggaggtggtggtgctgggcagccaggagggcgccatgcacaccgccctgaccggcgccaccgagatccagatgagcagcggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacgagaagggcgtgacccagaacggcaggctgatcaccgccaaccccatcgtgaccgagaaggacagccccgtgaacatcgaggccgagccccccttcggcgacagctacatcatcatcggtgtggagcccggccagctgaagctgcactggttcaagaagggcagcagcatcggccagatgttcgaggccaccgccaggggcgccaggaggatggccatcctgggcgacaccgcctgggacttcggcagcgcctacacc

SEQ ID NO: 307 - DNA, 1338 bp, Artificial Sequence
  Synthetic polynucleotide: 13F11-NPRM Round II shuffled clone no PRM
atgaggtgcgtgggcatcggcaaccgcgacttcgtggagggcgtgagcggcggcgcctgggtggacctggtgctggagcacggcggctgcgtgaccaccatggccaagaacaagcccaccctggacatcgagctgatcaagaccgaggccacccagcccgccaccctgaggaagtactgcatcgaggccaagatcaccaacatcaccaccgacagcaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacgagaagggcaaggcccacaacggcaggctgatcaccgccaaccccatcgtgatcgacaaggagaagcccgtgaacatcgagctggagccccccttcggcgagagctacatcgtggtgggcgccggcgagaaggccctgaagctgagctggttcaagaagggcagcagcatcggcaagatgttcgagagcacctacaggggcgccaagaggatggccatcctgggcgacaccgcctgggacttcggcagcgtgggcggcgtgttcaccagcatcggcaaggccctgcaccaggtgttcggcgccatctacggcgcc

SEQ ID NO: 308 - DNA, 1275 bp, Artificial Sequence
  Synthetic polynucleotide: 14B1-NPRM Round II shuffled clone no PRM
atgaggtgcgtgggcatcagcaacagggacttcgtggagggcgtgagcggcggcgcctgggtggacctggtgctggagcacggcggctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaacatcgtgcagcccgagaacctgaagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagagctggctggtgcacaagcagtggttcctggacctgcccctgccctggaccgccggcgccgacaccgagacccccacctggaacaggaaggagctgctggtgaccttcaagaacgcccacgccaagaggcaggacgtgaccgtgctgggcagccaggagggcgccatgcacagcgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcgtgatcagggtgcagtacgagggcgacggcgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcgccggcgagaaggccctgaagctgagctggttcaagaagggcagcagcatcggccagatgttcgagagcaccgccaggggcgccaggaggatggccatcctgggcgacaccgcctgggacttcggcagcgcctacacc

SEQ ID NO: 309 - DNA, 1338 bp, Artificial Sequence
  Synthetic polynucleotide: 14G10-NPRM Round II shuffled clone no PRM
atgaggtgcatcggcatcagcaacagggacttcgtggagggcgtgagcggcgccacctgggtggacgtggtgctggagcacggcggctgcgtgaccaccatggccaagaacaagcccaccctggacatcgagctgctgaagaccgaggtgaccaaccccgccaccctgaggaagtactgcatcgaggccaagatcaccaacatcaccaccgacaccaggtgccccacccagggcgaggccatcctgcccgaggagcaggaccagcagtacatctgcaggagggacgtggtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacagcggcgaggagcacgccgtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgagatccagatgagcagcggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 310 - DNA, 1332 bp, Artificial Sequence
  Synthetic polynucleotide: 14H2-NPRM Round II shuffled clone no PRM
atgaggtgcgtgggcgtgggcaacagggacttcgtggagggcgtgagcggcggcgcctgggtggacctggtgctggagcacggcggctgcgtgaccaccatggccaagaacaagcccaccctggacttcgagctgatcaagaccaccgccaaggaggtggccctgctgaggacctactgcatcgaggccaagatcaccaacatcaccaccgccaccaggtgccccacccagggcgagccctacctgaaggaggagcaggaccagaactacgtgtgcaagcacacctacgtggacaggggctggggcaacggctgcggcctgttcggcaagggcagcctgatcacctgcgccaagttccagtgcgtgaccaagctggagggcaacatcgtgcagcccgagaacctggagtacaccatcgtgatcaccccccacagcggcgaggagcacgccgtgggcaacgacacccagggcgtgaccgtggagatcaccccccaggccagcaccgtggaggccatcctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccgacaccagcgaggtgcactggaaccacaaggagaggatggtgaccttcaaggtgccccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacaagggcgaggacgccccctgcaagatccccttcagcagccaggacggccagggcaaggcccacaacggcaggctgatcaccgccaaccccatcgtgaccgagaaggacagccccgtgaacatcgaggccgagccccccttcggcgagagctacatcgtggtgggcgccggcgagaaggccctgaagctgagctggttcaagaagggcagcagcatcggccagatgttcgagaccaccatgaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 311 - DNA, 1341 bp, Artificial Sequence
  Synthetic polynucleotide: 15C2-NPRM Round II shuffled clone no PRM
atgaggtgcgtcggcatcagcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgagccctacctgaaggaggagcaggaccagcagtacatctgcaggagggacgtggtggacaggggctggggcaacggctgcggcctgttcggcaagggcagcgtggtgacctgcgccaagttccagtgcctggagcccatcgagggcaagatcgtgcagtacgagaacctgaagtacagcgtgatcgtgaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgaggtggacagcggcgacggcaaccacatgttcgccggccacctgaagtgcaggctgaagatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacgagaagggcgtgacccagaacggcaggctgatcaccgccaaccccatcgtgatcgacaaggagaagcccgtgaacatcgaggccgagccccccttcggcgagagctacatcgtcatcggcgtggagcccggccagctgaagctgcactggttcaagaagggcagcagcatcggccagatgttcgaggccaccgccaggggcgccaggaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 312 - DNA, 1338 bp, Artificial Sequence
  Synthetic polynucleotide: 15D4-NPRM Round II shuffled clone no PRM
atgaggtgcgtgggcatcggcaaccgcgacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcctggagcccatcgagggcaaggtggtgcagcccgagaacctggagtacaccatcgtgatcaccccccacagcggcgaggagcacgccgtgggcaacgacactggcaagcacggcaaggagatcaagatcaccccccagagcagcatcaccgaggccgagctgaccggctacggcaccgtgaccatggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacagcgccctggccggcgccaccgagatccagatgagcagcggcaacctgctgttcaccggccacctgaagtgcaggctgaggatggacaagctgaccctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcgccggcgacaaggccctgaagatcaactggtacaagaagggcagcagcatcggcaagatgttcgagagcacctacaggggcgccaagaggatggccatcttgggcgacaccgcctgggacttcggcagcctgggcggcgtgttcaccagcatcggcaaggccctgcaccaagtgttcggcgccatctacggcgcc

SEQ ID NO: 313 - DNA, 1341 bp, Artificial Sequence
  Synthetic polynucleotide: 15H4-NPRM Round II shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacttcgagctgatcaagaccgaggtgaccaaccccgccaccctgaggaagtactgcatcgaggccagcatcagcaacatcaccaccgccaccaggtgccccacccagggcgaggccaacctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggaggtggtggtgctgggcagccaggagggcgccatgcacagcgccctggccggcgccaccgagatccagatgagcagcggcaacctgctgttcaccggccgcctgaagtgcaggctgaagatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccctggagatcatggacctggagaagaggcacgtgctgggcaggctgatcaccgtgaaccccatcgtgatcgacaaggagaagcccgtgaacatcgaggccgagcccccctttggcgacagctacatcatcatcggcgtggagcccggccagctgaagctgcactggttcaagaagggcagcagcatcggccagatgttcgagagcacctacaggggcgccaagaggatggccatcctgggcgacaccgcctgggacttcggcagcgtgggcggcgtgctgaacagcctgggcaagatggtgcaccagatcttcggcagcgtgtacaccaccatgttcggc

SEQ ID NO: 314 - DNA, 1344 bp, Artificial Sequence
  Synthetic polynucleotide: 16B4-NPRM Round II shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaagaagacctggctggtgcacaagcagtggttcctcgacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaccaccaccatcttcgccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtcggcgtgggcgacaaggccctgaagatcaactggtacaagaagggcagcagcatcggccagatgttcgagaccaccatgaggggcgccaagaggatggccatcctgggcgacaccgcctgggacttcggcagcgtgggcggcctgctgaccagcctgggcaagatggtgcaccagatcttcggcagcgtgtacaccaccatgttcggc

SEQ ID NO: 315 - DNA, 1332 bp, Artificial Sequence
  Synthetic polynucleotide: 16F12-NPRMRound II shuffled clone no PRM
atgaggtgcgtgggcgtgggcaacggggacttcgtggagggcctgagcggcgccacctgggtggacgtggtgctggagcacggcagctgcgtgaccaccatggccaagaacaagcccaccctggacttcgagctgatcaagaccatcgccaaggaggtggccctgctgaggacctactgcatcgaggccagcatcagcaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccagcggcgccaccaccgaggtgcactggaaccacaaggagaggatggtgaccttcaagaccgcccacgccaagaagcaggacgtggtggtgctgggcagccaggagggcaccatgcacaccgccctgaccggcgccaccgagatccagatgagcagcggcaccaccaccatcttcgccggccacctgaagtgcaaggtgaagatggacaagctgcagctgaagggcatgagctacaccatgtgcaccggcaagttccagatcgtgaaggagatcgccgagacccagcacggcaccatcgtgatcagggtgcagtacgagggcgacggcgccccctgcaagatccccctggagatcatggacctggagaagaggcacgtgctgggcaggctgatcaccgtgaaccccatcgtgatcgacaaggagaagcccgtgaacatcgaggccgagccccccttcggcgagagctacatcgtggtcggcgtgggcgacagcgccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 316 - DNA, 1341 bp, Artificial Sequence
  Synthetic polynucleotide: 16G11-NPRM Round II shuffled clone no PRM
atgaggtgcgtgggcatcggcaaccgcgacttcgtggagggcctgagcggcgccacctgggtggacgtggtgctggagcacggcggctgcgtgaccaccatggccaagaacaagcccaccctggacatcgagctgctgaagaccgaggtgaccaaccccgccgtgctgaggaagctgtgcatcgaggccagcatcagcaacaccaccaccgacagcaggtgccccacccagggcgaggccaccctggtggaggagcaggacaccaacttcgtgtgcaggaggaccttcgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgaggccaccgccaggggcgccaggaggatggccatcctgggcgacaccgcctgggacttcggcagcctgggcggcctgctgaccagcctgggcaaggccgtgcaccaggtgttcggcagcgtgtacaccaccatgttcggc

SEQ ID NO: 317 - DNA, 1332 bp, Artificial Sequence
  Synthetic polynucleotide: 17A12-NPRMRound II shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacttcgagctgatcaagaccgaggccacccagcccgccaccctgaggaagtactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcctggagcccatcgagggcaaggtggtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaagaagagctggctggtgcacaagcagtggttcctggacctgcccctgccctggaccagcggcgccaccaccgagacccccacctggaacaggaaggagctgctggtgaccttcaagaacgcccacgccaagaggcaggacgtgaccgtgctgggcagccaggagggcgccatgcacagcgccctgaccggcgccaccgagatccagaccagcggcaccaccaccatcttcgccggccacctgaagtgcagggtgaggatggacaagctgcagctgaagggcatgagctacgtgatgtgcaccggcagcttcaagctggagaaggaggtggccgagacccagcacggcaccgtgctggtgcaggtgaagtacgagggcaccgacgccccctgcaagatccccgtcagcagccaggacgagaagggcgtgacccagaacggcaggctgatcaccgccaaccccatcgtgaccgagaaggacagccccgtgaacatcgaggccgagccccccttcggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacctcggcagcgtgggcggcgtgttcaccagcatcggcaaggccctgcaccaggtgttcggcgccatctacggcgcc

SEQ ID NO: 318 - DNA, 1332 bp, Artificial Sequence
  Synthetic polynucleotide: 17D5-NPRM Round II shuffled clone no PRM
atgaggtgcatcggcatcagcaacagggacttcgtggagggcgtgagcggcgccacctgggtggacgtggtgctggagcacggcggctgcgtgaccaccatggccaggaacaagcccaccctggacatcgagctgatcaagaccgaggccacccagcccgccaccctgaggaagtactgcatcgaggccagcatcagcaacatcaccaccgccaccaggtgccccacccagggcgaggccatcctgcccgaggagcaggaccagcagtacatctgcaggagggacgtggtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccagcggcgccaccaccgagacccccacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcgccggcgacaaggccctgaagatcaactggtacaagaagggcagcagcatcggcaagatgttcgagagcacctacaggggcgccaagaggatggccatcttgggcgacaccgcctgggacttcggcagcctgggcggcgtgttcaccagcatcggcaaggccctgcaccaggtgttcggcgccatctacggcgcc

SEQ ID NO: 319 - DNA, 1332 bp, Artificial Sequence
  Synthetic polynucleotide: 17D11-NPRM Round II shuffled clone no PRM
atgaggtgcgtgggcaccggcaaccgcgacttcgtggagggcctgagcggcgccacctgggtggacgtggtgctggagcacggcggctgcgtgaccaccatggcccagggcaagcccaccctggacatcgagctgatcaagaccgaggccacccagcccgccaccctgaggaagtactgcatcgaggccaagctgaccaataccaccaccgagagcaggtgccccacccagggcgagccctacctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaagaagagctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcaccgacgccccctgcaagatccccttcagcagccaggacgagaagggcgtgacccagaacggcaggctgatcaccgccaaccccatcgtgaccgagaaggacagccccgtgaacatcgaggccgagccccccttcggcgagagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 320 - DNA, 1341 bp, Artificial Sequence
  Synthetic polynucleotide: 17F5-NPRM Round II shuffled clone no PRM
atgaggtgcgtgggcgtgggcaacagggacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacagcgccctggccggcgccaccgagatccagatgagcagcggcaacctgctgttcaccggccacctgaagtgcaggctgaggatggacaagctgcagctgaagggcatgagctacgtgatgtgcaccggcaagttccagatcgtgaaggagatcgccgagacccagcacggcaccatcgtgatcagggtgcagtacgagggcgacgacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtcggcgtgggcgacagcgccctgaccctgcactggttcaggaagggcagcagcatcggccagatgttcgagaccaccatgaggggcgccaagaggatggccatcttgggcgacaccgcctgggacttcggcagcctgggcggcgtgttcaccagcctgggcaaggccgtgcaccagatcttcggcagcgtgtacaccaccatgttcggc

SEQ ID NO: 321 - DNA, 1341 bp, Artificial Sequence
  Synthetic polynucleotide: 17F11-NPRM Round II shuffled clone no PRM
atgaggtgcatcggcatcagcaacagggacttcgtggagggcgtgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaagcagtggctcctggacctgcccctgccctggaccgccggcgccgacaccagcgaggtgcactggaaccacaaggagaggatggtgaccttcaaggtgccccacgccaagaagcaggacgtggtggtgctaggcagccaggagggcgccatgcacaccgccctgaccggcgccaccgagatccagatgagcagcggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccacaacggcaggctgatcaccgccaaccccatcgtgatcgacaaggagaagcccgtgaacatcgagctggagccccccttcggcgacagctacatcgtgatcggcgtgggcgacagcgccctgaccctgcactggttcaggaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 322 - DNA, 1332 bp, Artificial Sequence
  Synthetic polynucleotide: 17G5-NPRM Round II shuffled clone no PRM
atgaggtgcgtgggcatcggcaaccgcgacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgaggccatcctgaaggaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaagaccgcccacgccaagaagcaggaggtggtggtgctgggcagccaggagggcgccatgcacagcgccctggccggcgccaccgaggtggacagcggcgacggcaaccacatgttcgccggccacctgaagtgcaaggtgaggatggacaagctgaccctgaagggcgtgagctacgtgatgtgcaccggcagcttcaagctggagaaggagatcgccgagacccagcacggcaccatcctgatcaaggtggagtacaagggcgaggacgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcgtgttcaccagcatcggcaaggccctgcaccaggtgttcggcgccatctacggcgcc

SEQ ID NO: 323 - DNA, 1296 bp, Artificial Sequence
  Synthetic polynucleotide: 17H3-NPRM Round II shuffled clone no PRM
atgaggtgcatcggcatcagcaacagggacttcgtggagggcgtgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaagaagacctggatggtgcacaggcagtggttcttcgacctgcccctgccctggaccgccggcgccgacaccagcgaggtgcactggaaccacaaggagaggatggtgaccttcaagaccgcccacgccaagaggcaggacgtgaccgtgctgggcagccaggagggcgccatgcacagcgccctgaccggcgccaccgaggtggacagcggcgacggcaacctgctgttcaccggccacctgaagtgcaggctgaagatggacaagctgcagctgaagggcatgagctacaccatgtgcaccggcaagttccagatcgtgaaggagatcgccgagacccagcacggcaccatcctgatcaaggtggagtacaagggcgaggacgccccctgcaagatccccttcagcaccgaggacggccagggcaaggcccacaacggcaggctgatcaccgccaaccccgcggtgaccgacaaggagaagcccgtgaacatcgagctggagccccccttcggcgacagctacatcgtggtgggcgccggcgacaaggccctgaagctgagctggttcaagaagggcagcagcatcggccagatgttcgagagcacctacaggggcgccaagaggatggccatcctgggcgagaccgcctgggacctgggcagcatcggcggcgtgttcaccagcgtgggcaag

SEQ ID NO: 324 - DNA, 1341 bp, Artificial Sequence
  Synthetic polynucleotide: 17H10-NPRM Round II shuffled clone no PRM
atgaggtgcatcggcatcagcaacagggacttcgtggagggcgtgagcggcggcagctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccatcatgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaacaaggcctggatggtgcacaggcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacgtgatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccatcgtgatcgacaaggagaagcccgtgaacatcgagctggagccccccttcggcgacagctacatcgtggtgggcgccggcgacaaggccctgaagatcaactggtacaagaagggcagcagcatcggcaagatgttcgaggccaccgccaggggcgccaggaggatggccatcctgggcgacaccgcctgggacttcggcagcgtgggcggcgtgctgaccagcctgggcaagatggtgcaccagatcttcggcagcgtgtacaccaccatgttcggc

SEQ ID NO: 325 - DNA, 1347 bp, Artificial Sequence
  Synthetic polynucleotide: 17H12-NPRM Round II shuffled clone no PRM
atgaggtgcgtgggcgtgggcaacagggacttcgtggagggcctgagcggcgccacctgggtggacgtggtgctggagcacggcagctgcgtgaccaccatggcccagggcaagcccaccctggacatcgagctgctgaagaccgaggtgaccaaccccgccaccctgaggaagtactgcatcgaggccaagctgaccaataccaccaccgagagcaggtgccccacccagggcgagccctacctgaaggaggagcaggaccagcagtacatctgcaggagggacgtggtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgaggtggacagcggcgacggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcaaggtggagtacaagggcgaggacgccccctgcaagatccccttcagcaccgaggacggccagggcaaggcccacaacggcaggctgatcaccgccaaccccatcgtgatcgacaaggagaagcccgtgaacatcgaggccgagccccccttcggcgagagctacatcgtggtgggcgccggcgagaaggccctgaagctgagctggttcaagaagggcagcagcatcggccagatgttcgagaccaccatgaggggcgccaagaggatggccatcctgggcgacaccgcctgggacttcggcagcgtgggcggcctgctgaccagcctgggcaagatggtgcaccagatcttcggcagcgtgtacaccaccatgttcggc

SEQ ID NO: 326 - DNA, 1341 bp, Artificial Sequence
  Synthetic polynucleotide: 18A9-NPRM Round II shuffled clone no PRM
atgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgccaccaggtgccccacccagggcgaggccatcctgcccgaggagcaggaccagaactacgtgtgcaagcacagcatggtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacgagatgatcctgctgaccatgaagaacaaggcctggatggtgcacaagcagtggttcctggacctgcccctgccctggaccgccggcgccgacaccagcgaggtgcactggaaccacaaggagaggatggtgaccttcaaggtgccccacgccaagaggcaggacgtgaccgtgctgggcagccaggagggcgccatgcacagcgccctggccggcgccaccgagatccagatgagcagcggcaacctgctgttcaccggccacctgaagtgcaggctgaggatggacaagctgaccctgaagggcgtgagctacgtgatgtgcaccggcaagttccagatcgtgaaggagatcgccgagacccagcacggcaccatcgtgatcagggtgcagtacgagggcaccgacgccccctgcaagatccccttcagcagccaggacgagaagggcgtgacccagaacggcaggctgatcaccgccaaccccatcgtgatcgacaaggagaagcccgtgaacatcgagctggagccccccttcggcgacagctacatcgtggtgggcgccggcgacaaggccctgaccctgcactggttcaggaagggcagcagcatcggccagatgttcgagaccaccatgaggggcgccaagaggatggccatcctgggcgacaccgcctgggacttcggcagcgtgggcggcctgctgaccagcctgggcaagatggtgcaccagatcttcggcagcgtgttcaccagcgtgggcaag

SEQ ID NO: 327 - DNA, 1341 bp, Artificial Sequence
  Synthetic polynucleotide: 18B7-NPRM Round II shuffled clone no PRM
atgaggtgcatcggcatcagcaacagggacttcgtggagggcctgagcggcgccacctgggtggacgtggtgctggagcacggcagctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgagccctacctgaaggaggagcaggaccagcagtacatctgcaggagggacgtggtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaagcagtggttcctggacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgaggtggacagcggcgacggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcctgatcaaggtggagtacaagggcgaggacgccccctgcaagatccccttcagcaccgaggacgagaagggcgtgacccagaacggcaggctgatcaccgccaaccccatcgtgatcgacaaggagaagcccgtgaacatcgaggccgagccccccttcggcgacagctacatcgtggtgggcgccggcgacaaggccctgaagatcaactggtacaagaagggcagcagcatcggcaagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 328 - DNA, 1344 bp, Artificial Sequence
  Synthetic polynucleotide: 18D7-NPRM Round II shuffled clone no PRM
atgaggtgcatcggcatcagcaacagggacttcgtggagggcgtgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgacacccagggcgtgaccgtggagatcaccccccaggccagcaccgtggaggccatcctgcccgagtacggcaccctgggcctggagtgcagccccaggaccggcctggacttcaacgagatgatcctgctgaccatgaagaacaaggcctggatggtgcacaggcagtggttcttcgacctgcccctgccctggaccgccggcgccgacaccagcgaggtgcactggaaccacaaggagaggatggtgaccttcaagaccgcccacgccaagaagcaggacgtggtggtgctgggcagccaggagggcgccatgcacaccgccctgaccggcgccaccgagatccagatgagcagcggcaccaccaccatcttcgccggccacctgaagtgcaggctgaagatggacaagctgcagctgaagggcatgagctacagcatgtgcaccggcaagttccagatcgtgaaggagatcgccgagacccagcacggcaccatcctgatcaaggtgaagtacgagggcaccgacgccccctgcaagatccccttcagcagccaggacgagaagggcgtgacccagaacggcaggctgatcaccgccaaccccatcgtgaccgagaaggacagccccgtgaacatcgaggccgagccccccttcggcgagagctacatcgtggtgggcgccggcgagaaggccctgaagctgagctggttcaagaagggcagcagcatcggccagatgttcgagagcacctacaggggcgccaagaggatggccatcctgggcgagaccgcctgggacttcggcagcgtgggcggcctgctgaccagcctgggcaaggccgtgcaccaggtgttcggcagcgtgtacaccaccatgttcggc

SEQ ID NO: 329 - DNA, 1347 bp, Artificial Sequence
  Synthetic polynucleotide: 18H2-NPRM Round II shuffled clone no PRM
atgaggtgcgtgggcgtgggcaacagggacttcgtggagggcgtgagcggcggcgcctgggtggacctggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccatcctgcccgaggagcaggaccagaactacgtgtgcaagcacacctacgtggacaggggctggggcaacggctgcggcctgttcggcaagggcagcgtggtgacctgcgccaagttccagtgcctggagcccatcgagggcaaggtggtgcagcacgagaacctgaagtacaccgtgatcatcaccgtgcacaccggcgaccagcaccaggtgggcaacgacaccagcaaccacggcgtgaccgtggagatcaccccccaggccagcaccgtggaggccatcctgcccgagtacggcaccctgggcctggagtgcagccccaggaccggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaaggtgccccacgccaagaagcaggacgtggtggtgctgggcagccaggagggcgccatgcacaccgccctggccggcgccaccgagatccagatgagcagcggcaacctgctgttcaccggccacctgaagtgcaggctgaagatggacaagctgcagctgaagggcatgagctacagcatgtgcaccggcaagttccagatcgtgaaggagatcgccgagacccagcacggcaccatcgtgatcagggtgcagtacgagggcgacggcgccccctgcaagatccccttcagcaccgaggacggccagggcaaggcccacaacggcaggctgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgagaccaccatgaggggcgccaagaggatggccatcttgggcgacaccgcctgggacttcggcagcgtgggcggcctgctgaccagcctgggcaagatggtgcaccagatcttcggcagcgtgtacaccaccatgttcggc

SEQ ID NO: 330 - DNA, 1332 bp, Artificial Sequence
  Synthetic polynucleotide: 18H6-NPRM Round II shuffled clone no PRM
atgaggtgcgtgggcgtgggcaacagggacttcgtggagggcctgagcggcgccacctgggtggacgtggtgctggagcacggcggctgcgtgaccaccatggccaagaacaagcccaccctggacttcgagctgatcaagaccaccgccaaggaggtggccctgctgaggacctactgcatcgaggccagcatcagcaacatcaccaccgccaccaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttcacctgcaagaagaacatggagggcaacatcgtgcagcccgagaacctggagtacaccatcgtgatcaccccccacaccggcgaccagcaccaggtgggcaacgacacccagggcgtgaccgtggagatcaccccccaggccagcaccgtggaggccatcctgcccgagtacggcaccctgggcctggagtgcagccccaggactggcctggacttcaacagggtggtgctgctgaccatgaagaagaagagctggctggtgcacaagcagtggttcctggacctgcccctgccctggaccgccggcgccgacaccagcgaggtgcactggaaccacaaggagaggatggtgaccttcaagaacgcccacgccaagaggcaggacgtgaccgtgctgggcagccaggagggcgccatgcacagcgccctggccggcgccaccgagatccagatgagcagcggcaacctgctgttcaccggccacctgaagtgcaggctgaagatggacaagctgcagctgaagggcgtgagctacgtgatgtgcaccggcagcttcaagctggagaaggaggtggccgagacccagcacggcaccgtgctggtgcaggtgaagtacgagggcaccgacgccccctgcaagatccccttcagcaccgaggacggccagggcaaggcccacaacggcaggctgatcaccgtgaaccccatcgtgatcgacaaggagaagcccgtgaacatcgagctggagccccccttcggcgagagctacatcgtggtgggcgccggcgagaaggccctgaagctgagctggttcaagaagggcagcagcatcggcaagatgttcgaggccaccgccaggggcgccaagaggatggccatcctgggcgagaccgcctgggacttcggcagcgtgggcggcctgctgaccagcctgggcaaggccgtgcaccaggtgttcggcgccatctacggcgcc

SEQ ID NO: 331 - DNA, 46 bp, Artificial Sequence
  Synthetic polynucleotide: pMaxVax ("pMV" or "PMV") primer 1
acacatagcgccggcgctagctgagcaaaaggccagcaaaaggcca

SEQ ID NO: 332 - DNA, 60 bp, Artificial Sequence
  Synthetic polynucleotide: pMaxVax primer 2
aactctgtgagacaacagtcataaatgtacagatatcagaccaagtttactcatatatac

SEQ ID NO: 333 - DNA, 39 bp, Artificial Sequence
  Synthetic polynucleotide: pMaxVax primer 3
ggcttctcacagagtggcgcgccgtgtctcaaaatctct

SEQ ID NO: 334 - DNA, 40 bp, Artificial Sequence
  Synthetic polynucleotide: pMaxVax primer 4
ttgctcagctagcgccggcgccgtcccgtcaagtcagcgt

SEQ ID NO: 335 - DNA, 40 bp, Artificial Sequence
  Synthetic polynucleotide: pMaxVax primer 5
agatctgtttaaaccgctgatcagcctcgactgtgccttc

SEQ ID NO: 336 - DNA, 40 bp, Artificial Sequence
  Synthetic polynucleotide: pMaxVax primer 6
acctctaaccactctgtgagaagccatagagcccaccgca

SEQ ID NO: 337 - DNA, 53 bp, Artificial Sequence
  Synthetic polynucleotide: pMaxVax primer 7
ggatccggtacctctagagaattcggcggccgcagatctgtttaaaccgctga

SEQ ID NO: 338 - protein, 434 aa, Dengue virus type 1
  DEN-1 E-truncated parent (tE)
MRCVGIGNRDFVEGLSGATWVDVVLEHGSCVTTMAKNKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNRVVLLTMKKKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVIDKEKPVNIEAEPPFGESYIVVGAGEKALKLSWFKKGSSIGKMFEATARGARRMAILGDTAWDLGSIGGVFTSVGK

SEQ ID NO: 339 - protein, 446 aa, Dengue virus type 2
  DEN-2 E-truncated parent (tE)
MRCIGISNRDFVEGVSGGSWVDIVLEHGSCVTTMAKNKPTLDFELIKTEATQPATLRKYCIEAKLTNTTTESRCPTQGEPSLNEEQDKRFVCKHSMVDRGWGNGCGLFGKGGIVTCAMFTCKKNMEGNIVQPENLEYTIVITPHSGEEHAVGNDTGKHGKEIKITPQSSITEAELTGYGTVTMECSPRTGLDFNEIVLLQMEDKAWLVHRQWFLDLPLPWLPGADTQGSNRIQKETLVTFKNPHAKKQDVVVLGSQEGAMHTALTGATEIQMSSGNLLFTGHLKCRLRMDKLQLKGMSYSMCTGKFQIVKEIAETQHGTIVIRVQYEGDGSPCKIPLEIMDLEKRHVLGRLITVNPIVTEKDSPVNIEAEPPFGDSYIIIGVEPGQLKLHWFKKGSSIGQMFETTMRGAKRMAILGDTAWDFGSLGGVFTSIGKALHQVFGAIYGA

SEQ ID NO: 340 - protein, 443 aa, Dengue virus type 3
  DEN-3 E-truncated parent (tE)
MRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLEPIEGKVVQHENLKYTVIITVHTGDQHQVGNDTQGVTVEITPQASTVEAILPEYGTLGLECSPRTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCLNTFVLKKEVSETQHGTILIKVEYKGEDAPCKIPFSTEDGQGKAHNGRLITANPVVTKKEEPVNIEAEPPFGESNIVIGIGDKALKINWYKKGSSIGKMFEATARGARRMAILGDTAWDFGSVGGVLNSLGKMVHQIFGSAYT

SEQ ID NO: 341 - protein, 449 aa, Dengue virus type 4
  DEN-4 E-truncated parent (tE)
MRCVGVGNRDFVEGVSGGAWVDLVLEHGGCVTTMAQGKPTLDFELIKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNHKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGTGAPCKVPIEIRDVNKEKVVGRIISSTPLAENTNSVTNIELEPPFGDSYIVIGVGDSALTLHWFRKGSSIGKMFESTYRGAKRMAILGETAWDFGSVGGLLTSLGKAVHQVFGSVYTTMFG

SEQ ID NO: 342 - DNA, 2031 bp, Artificial Sequence
  Synthetic polynucleotide: 30F10 (C15/full prM/full E)
atgagatctaccatcaccctgctctgcctgatccctactgttatggccttctctctgtcaacaagagatggcgagcctctcatgatcgtggccaagcacgaaagagggaggcctctgctgttcaagactactgaagggatcaataagtgcactctcatcgccatggacctgggcgagatgtgtgaggataccgtgacctacaagtgtccactgctggtcaacaccgaacccgaggatatcgattgctggtgcaatctgacttctacttgggtgatgtatgggacctgtacccagtccggagagagaaggagggagaagaggtccgtcgccctggctcctcacgttggtatgggcctggacaccagaactcagacatggatgagcgctgagggagcttggaagcacgcccagagggttgaatcttggattctgcgcaatccacgctttgcactcctggctggcttcatggcttatatgattgggcagactggtattcagaggaccgtcttcttcgttctgatgatgctcgtggcaccatcttacggcatgaggtgcgtgggcgtgggcaacagggacttcgtggagggcgtgagcggcggcgcctgggtggacgtggtgctggagcacggcagctgcgtgaccaccatggccaagaacaagcccaccctggacatcgagctgctgaagaccgaggtgaccaaccccgccaccctgaggaagtactgcatcgaggccaagatcaccaacatcaccaccgacagcaggtgccccacccagggcgaggccaccctggtggaggagcaggacaccaacttcgtgtgcaggaggaccttcgtggacaggggctggggcaacggctgcggcctgttcggcaagggcggcatcgtgacctgcgccaagttcaagtgcgtgaccaagctggagggcaacatcgtgcagcccgagaacctggagtacaccatcgtgatcaccccccacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcaccaccgagatccagaacagcggcggcaccctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcaaggtggagtacaagggcgaggacgccccctgcaagatccccttcagcaccgaggacgagaagggcgtgacccagaacggcaggctgatcaccgccaaccccatcgtgaccgagaaggacagccccgtgaacatcgaggccgagccccccttcggcgagagctacatcgtggtgggcatcggcgacaaggccctgaagatcaactggtacaagaagggcagcagcatcggcaagatgttcgaggccaccgccaggggcgccaggaggatggccatcctgggcgagaccgcctgggacttcggcagcgtgggcggcctgctgaccagcctgggcaaggccgtgcaccaggtgttcggcagcgtgtacaccacaatgtttggcggcgtctcttggatggtgagaatcctgatcgggttcctcgtcctgtggattggaaccaatagcaggaatacaagcatggccatgagctgcatcgctgttggcggcatcacactcttcctgggtttcaccgttcacgca

SEQ ID NO: 343 - protein, 677 aa, Artificial Sequence
  Synthetic polypeptide:  30F10 (C15/full prM/full E)
MRSTITLLCLIPTVMAFSLSTRDGEPLMIVAKHERGRPLLFKTTEGINKCTLIAMDLGEMCEDTVTYKCPLLVNTEPEDIDCWCNLTSTWVMYGTCTQSGERRREKRSVALAPHVGMGLDTRTQTWMSAEGAWKHAQRVESWILRNPRFALLAGFMAYMIGQTGIQRTVFFVLMMLVAPSYGMRCVGVGNRDFVEGVSGGAWVDVVLEHGSCVTTMAKNKPTLDIELLKTEVTNPATLRKYCIEAKITNITTDSRCPTQGEATLVEEQDTNFVCRRTFVDRGWGNGCGLFGKGGIVTCAKFKCVTKLEGNIVQPENLEYTIVITPHTGDQHQVGNETTEHGTIATITPQAPTSEIQLTDYGALTLDCSPRTGLDFNRVVLLTMKKKTWLVHKQWFLDLPLPWTAGASTSQETWNRKELLVTFKNAHAKKQEVVVLGSQEGAMHTALTGTTEIQNSGGTLLFTGHLKCRLRMDKLQLKGMSYSMCTGKFQIVKEIAETQHGTIVIKVEYKGEDAPCKIPFSTEDEKGVTQNGRLITANPIVTEKDSPVNIEAEPPFGESYIVVGIGDKALKINWYKKGSSIGKMFEATARGARRMAILGETAWDFGSVGGLLTSLGKAVHQVFGSVYTTMFGGVSWMVRILIGFLVLWIGTNSRNTSMAMSCIAVGGITLFLGFTVHA

SEQ ID NO: 344 - DNA, 2031 bp, Artificial Sequence
  Synthetic polynucleotide: 30G2 (C15/full prM/full E)
atgagatctgtgaccatgattctcatgctgctgcctactgctctggccttccatctgacaacaagagatggcgagcctaggatgatcgtgggcaagaacgaaagagggaagagcctgctgttcaagactgcttcagggatcaatatgtgcactctcatcgccatggacctgggcgagatgtgtgaggataccatgacctacaagtgtccacggatgaccgaggccgaacccgacgatgtggattgctggtgcaatgcaactgatacttgggtgacctatgggacctgtagccagacaggcgagcataggagggataagaggtccgtcgccctggaccctcacgttggtctgggcctggaaaccagaaccgagacatggatgagctctgagggagcttggaagcacgcccagagggttgaatcttggattctgcgcaatccacgctttgcactcctggctggcttcatggcttatatgattgggcagactggtattcagaggaccgtcatcttcattctgctcatgctcgtgacaccatctatggccatgaggtgcgtgggcatcggcaaccgcgacttcgtggagggcctgagcggcgccacctgggtggacgtggtgctggagcacggcagctgcgtgaccaccatggccaagaacaagcccaccctggacatcgagctgctgaagaccgaggtgaccaaccccgccgtgctgaggaagctgtgcatcgaggccaagatcagcaacaccaccaccgacagcaggtgccccacccagggcgaggccatcctgcccgaggagcaggaccagaactacgtgtgcaagcacacctacgtggacaggggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagaccaccgagcacggcaccatcgccaccatcaccccccaggcccccaccagcgagatccagctgaccgactacggcgccctgaccctggactgcagccccaggaccggcctggacttcaacagggtggtgctgctgaccatgaagaagaagacctggctggtgcacaagcagtggttcctggacctgcccctgccctggaccgccggcgccagcaccagccaggagacctggaacaggaaggagctgctggtgaccttcaagaacgcccacgccaagaagcaggaggtggtggtgctgggcagccaggagggcgccatgcacaccgccctgaccggcgccaccgaggtggacagcggcgacggcaacctgctgttcaccggccacctgaagtgcaggctgaggatggacaagctgcagctgaagggcatgagctacagcatgtgcaccggcaagttccagatcgtgaaggagatcgccgagacccagcacggcaccatcgtgatcagggtgaagtacgagggcaccgacgccccctgcaagatccccttcagcagccaggacgagaagggcgtgacccagaacggcaggctgatcaccgccaaccccatcgtgatcgacaaggagaagcccgtgaacatcgaggccgagcccccctttggcgacagctacatcatcatcggcgtggagcccggccagctgaagctgcactggttcaagaagggcagcagcatcggccagatgttcgagaccaccatgaggggcgccaagaggatggccatcctgggcgacaccgcctgggacttcggcagcctgggcggcgtgttcaccagcatcggcaaggccctgcaccaggttttcggtgcaatctatggcgtgctgtttttcggcgtctcttggaccatgaagatcggtattggcatcctcctcacatggctgggactgaatagcaagaatacaagcatgagctttagctgcatcgctattggcatcatcacactctacctgggtgtggtggttcaggca

SEQ ID NO: 345 - protein, 677 aa, Artificial Sequence
  Synthetic polypeptide:  30G2 (C15/full prM/full E)
MRSVTMILMLLPTALAFHLTTRDGEPRMIVGKNERGKSLLFKTASGINMCTLIAMDLGEMCEDTMTYKCPRMTEAEPDDVDCWCNATDTWVTYGTCSQTGEHRRDKRSVALDPHVGLGLETRTETWMSSEGAWKHAQRVESWILRNPRFALLAGFMAYMIGQTGIQRTVIFILLMLVTPSMAMRCVGIGNRDFVEGLSGATWVDVVLEHGSCVTTMAKNKPTLDIELLKTEVTNPAVLRKLCIEAKISNTTTDSRCPTQGEAILPEEQDQNYVCKHTYVDRGWGNGCGLFGKGSLVTCAKFQCLEPIEGKVVQHENLKYTVIITVHTGDQHQVGNETTEHGTIATITPQAPTSEIQLTDYGALTLDCSPRTGLDFNRVVLLTMKKKTWLVHKQWFLDLPLPWTAGASTSQETWNRKELLVTFKNAHAKKQEVVVLGSQEGAMHTALTGATEVDSGDGNLLFTGHLKCRLRMDKLQLKGMSYSMCTGKFQIVKEIAETQHGTIVIRVKYEGTDAPCKIPFSSQDEKGVTQNGRLITANPIVIDKEKPVNIEAEPPFGDSYIIIGVEPGQLKLHWFKKGSSIGQMFETTMRGAKRMAILGDTAWDFGSLGGVFTSIGKALHQVFGAIYGVLFFGVSWTMKIGIGILLTWLGLNSKNTSMSFSCIAIGIITLYLGVVVQA

What is claimed is:

1. A non-naturally occurring polypeptide comprising a polypeptide sequence having at least 95% sequence identity to the polypeptide sequence of SEQ ID NO:251, wherein said polypeptide induces production of neutralizing antibodies against at least one dengue virus.

2. The polypeptide of claim 1, wherein said at least one dengue virus is selected from the group consisting of dengue-1, dengue-2, dengue-3, and dengue-4.

3. The polypeptide of claim 1, wherein said polypeptide comprises a polypeptide sequence having at least 96% sequence identity to the polypeptide sequence of SEQ ID NO:251, wherein said polypeptide induces production of neutralizing antibodies against at least two dengue viruses of different serotypes selected from the group consisting of dengue-1, dengue-2, dengue-3, and dengue-4.

4. A composition comprising the polypeptide of claim 1 and a carrier.

5. The composition of claim 4, wherein the carrier is a pharmaceutically acceptable carrier.

6. The polypeptide of claim 1, wherein said polypeptide comprises a polypeptide sequence having at least 97% sequence identity to the polypeptide sequence of SEQ ID NO:251.

7. The polypeptide of claim 6, wherein said polypeptide comprises a polypeptide sequence having at least 98% sequence identity to the polypeptide sequence of SEQ ID NO:251.

8. The polypeptide of claim 7, wherein said polypeptide comprises the polypeptide sequence of SEQ ID NO:251.

9. The polypeptide of claim 7, wherein said polypeptide comprises a polypeptide sequence having at least 99% sequence identity to the polypeptide sequence of SEQ ID NO:251.

10. The polypeptide of claim 6, wherein said at least one dengue virus is selected from the group consisting of dengue-1, dengue-2, dengue-3, and dengue-4.

11. A non-naturally occurring polypeptide comprising a polypeptide sequence having at least 95% sequence identity to the polypeptide sequence of SEQ ID NO:251, wherein said polypeptide induces an immune response against at least one dengue virus.

12. The polypeptide of claim 11, wherein said at least one dengue virus is selected from the group consisting of dengue-1, dengue-2, dengue-3, and dengue-4.

13. The polypeptide of claim 12, wherein said polypeptide induces an immune response against at least two dengue viruses of different serotypes selected from the group consisting of dengue-1, dengue-2, dengue-3, and dengue-4.

14. A composition comprising the polypeptide of claim 11 and a carrier.

* * * * *